United States Patent 11,596,699 (RNA ENCODING AN ANTIBODY) - sequence listing, part 3

SEQ ID NO: 11602 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgagcgcgggggccaggggugguacuucgaccuguggggccggggcacgcucaucgugguguccagc

SEQ ID NO: 11603 - RNA, 381 nt, Artificial Sequence
  derived and/or modified sequence opt1 from anti-HIV-1_HeavyChain
caggugcagcugguccagagcggggccgaggugaagaagcccggggccuccgugaaggucagcugcaaggcguccggcuacaccuacaccacguacggggugagcuggcuccgccaggugccgggccagcggcccgaguggaugggguggauccgccccaagaccggcgcccggaaccaggcccgccaguuccagccccggaucucccugacccgcgaccgggcccugagcaccgccuaccucgaccugaacucccugacgagcgcggacuccggcaccuacuucugcgcccgccagaccuucaagccggacuucuacuucgccgaccagggguggagcuucaaccucuggggccggggcgcccacuucaucgucuccagc

SEQ ID NO: 11604 - RNA, 384 nt, Artificial Sequence
  derived and/or modified sequence opt1 from anti-HIV-1_HeavyChain
cgcgcccaccuggagcagagcggcuccggggugaagaagcucggcgccagcguccggguguccugcuggaccagcgaggacaucuucgagcgcaccgagcugauccacugggugcggcaggcgcccgggcagggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuucugcgcgcggcagaaguucgagagccgcuacaccggcgggcagggcugguacuucgaccugugggggcggggcacccacaucaccguguccagc

SEQ ID NO: 11605 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagaucguguccggcgccgugaacuucggcagccccaacuuccggcagcgcgucucccugacgcgggaccgcgaccucuucaccgcccacauggacauccgggggcugacccagggcgacaccgccacguacuacugcgcccgccagaaguucgagcgcgggggccagggguggaucuucgaccuguggggccggggcacccucaucgcggugagcucc

SEQ ID NO: 11606 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuucugcgcgcgccagaaguucgcccggggcgaccaggggugguucuucgaccuguggggccacgggacccugaucguggugagcucc

SEQ ID NO: 11607 - RNA, 375 nt, Artificial Sequence
  derived and/or modified sequence opt1 from anti-HIV-1_HeavyChain
caggcccaccuggagcagagcggcuccggggugaagaagcccggcgccagcguccggguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucgagcgcgggggccaggggugguacuucgaccuguggggccacggcacccucaucgugguguccagc

SEQ ID NO: 11608 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgacggggaccucuucaccgcccacauggacauccggggccugacccagggggacacggccaccuacuucugcgcccgccagaaguucuacgcgggcgggcagggcugguacuucgaccuguggggccgggggacccucaucaucguguccagc

SEQ ID NO: 11609 - RNA, 372 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggccaccagaucagcgaccgcgucucccugacccgggaccgcgaccucuucaccgcccacauggacauccgggggcugacccagggcgacacggccaccuacuucugcgcccgccagaaguucuacgccgggggccaggggugguacuucgaccuguggggccacggcacccucaucguggugagcucc

SEQ ID NO: 11610 - RNA, 375 nt, Artificial Sequence
  derived and/or modified sequence opt1 from anti-HIV-1_HeavyChain
caggcccaccuggagcagagcggcuccggggugaagaagcccggcgccagcguccggguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacacggccaccuacuucugcgcccgccagaaguucgagcgcgggggccaggggugguacuucgaccuguggggccacggcacccucaucguggugagcucc

SEQ ID NO: 11611 - RNA, 375 nt, Artificial Sequence
  derived and/or modified sequence opt1 from anti-HIV-1_HeavyChain
caggcccaccuggagcagagcggcgccggggugaagaagcccggcgcguccguccgcgugagcugcuggaccuccgaggacaucuucgagcggaccgagcucauccacugggugcgccaggccccggggcagggccuggaguggaucgggugggucaagacggugagcggcgccgugaacuucggcucccccaacuuccggcaccgcgucagccugacccgggaccgcgaccucuucaccgcccacauggacauccgggggcugacccagggcgacacggccaccuacuacugcgcgcgccagaaguucgagcgcgggggccaggggugguacuucgaccuguggggccggggcacccucaucgugguguccagc

SEQ ID NO: 11612 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcggggccuggaguggaucgggugggucaaggccguguccggcgccgugaacuacggcagccucgacuuccgccaccgggucucccugacgcgcgaccgggaccuguucaccgcccacauggacauccgcgggcucacccaggacgacaccgccacguacuacugcgcgcggcagaaguucgagcgcggcgggcagggcuggaucuucgaccugugggggcggggcacccugaucgccgugagcucc

SEQ ID NO: 11613 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuacugcgcccggcagaaguucuacgccgggggccaggggugguacuucgaccuguggggccgcggcacccucaucgugguguccagc

SEQ ID NO: 11614 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuucugcgcccgccagaaguucuacaagggcgggcaggggugguacuucgaccuguggggccggggcacccucaucgugguguccagc

SEQ ID NO: 11615 - RNA, 372 nt, Artificial Sequence
  derived and/or modified sequence opt1 from anti-HIV-1_HeavyChain
uacguggagcugggcaccaacaccgggcccgagguccgcaagccgggcgccagcgugaagaucuccugcaagacgagcggguacaucuucaccgacaacuacuuccacuggcuccggcaggcccccgcggugggccuggaguggaugggguggaucaacucccacaacggcuacaccaagagcgccaagaaguuccagggccgcaucaccaugacgcgggacaccgccgucgacaccgccuacauggagcugaucgaccucaccuccgacgacacggccaccuacuacugcgcgcgccagaaguucuacgccgggggccaggggugguacuucgaccuguggggcugcgggacccugaucguggugagcucc

SEQ ID NO: 11616 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccgcggcacccucaucugcguguccagc

SEQ ID NO: 11617 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcuccagcgacuuccggcagcgcgucucccugacccgggaccgcgaccucuucaccgcccacauggacauccgggggcugacgcagggcgacaccgccaccuacuacugcgcccgccagaaguucuacgccgggggccaggggugguacuucgaccuguggggccggggcacccucaucguggugagcucc

SEQ ID NO: 11618 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagcccgugacgggcgccgugaacuucggcucccccaacuuccggcaccgcgucagccugacccgggaccgcgaccucuucaccgcccacauggacauccgggggcugacccagggcgacacggccaccuacuucugcgcccgccagaaguucgagcgcgggggccaggggugguacuucgaccuguggggccggggcacccucaucgugguguccagc

SEQ ID NO: 11619 - RNA, 375 nt, Artificial Sequence
  derived and/or modified sequence opt1 from anti-HIV-1_HeavyChain
caggugcagcugguccagagcggcgccgaggugaagaagcccggggccuccgugcgcgucagcugcuggaccuccgaggacaucuucgagaaguccgagcucauccacugggugcggcaggcgccgggccaggggcuggaguggaucggcugggugaagaccgucacgggggccgugaacuucggcagcagcgacuuccgccagcgggugucccugacccgcgaccgggaccucuucaccgcccacauggacauccgcggccugacccagggggacacggccaccuacuacugcgcccggcagaaguucgagcgcggcgggcagggcugguacuucgaccugugggggcggggcacccucaucgucgugagcucc

SEQ ID NO: 11620 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccugagcaccgcccacauggacauccgggggcucacccaggacgacaccgccacguacuccugcgcgcgccagaaguucgcccggggcgaccaggggugguucuucgaccuguggggccgcgggacccugaucguggugagcucc

SEQ ID NO: 11621 - RNA, 375 nt, Artificial Sequence
  derived and/or modified sequence opt1 from anti-HIV-1_HeavyChain
caggcccaccuggagcagagcggcuccggggugaagaagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuacugcgcccgccagaaguucgagcgcgggggccaggggugguacuucgaccuguggggccggggcacgcucaucgugguguccagc

SEQ ID NO: 11622 - RNA, 375 nt, Artificial Sequence
  derived and/or modified sequence opt1 from anti-HIV-1_HeavyChain
caggcccaccuggagcagagcggcuccggggugaagaagcccggcgccagcguccggguguccugcuggaccagcgaggacaucuucgagcggaccgagcucauccacugggugcgccaggcgccggggcagggccuggaguggaucgggugggucaagacggugaccggcaccgugaacuucggcucccugaacuuccggcagcgcgucagccucacccgggaccgcgaccuguucacggcccacauggacauccgggggcugacccagggcgacaccgccaccuacuucugcgcccgccagaaguucgcccgcggggaccagggcugguucuucgaccucugggggcacggcacgcugaucgugguguccagc

SEQ ID NO: 11623 - RNA, 375 nt, Artificial Sequence
  derived and/or modified sequence opt1 from anti-HIV-1_HeavyChain
caggcccaccuggagcagagcggcuccggggugaagaagcccggcgccagcguccggguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccccuucaccgcccacauggacauccgggggcucacgcagggcgacaccgccaccuacuucugcgcccgccagaaguucgagcgcgggggccaggggugguacuucgaccuguggggccacggcacccugaucgugguguccagc

SEQ ID NO: 11624 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacaucugcgggcugacgcagggcgacaccgccaccuacuucugcgcccggcagaaguucgagcgcgggggccaggggugguacuucgaccuguggggccacggcacccucaucgugguguccagc

SEQ ID NO: 11625 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcagcgcgucucccugacgcgggaccgcgaccuguucaccgcccacauggacauccgggggcucacccagggcgacaccgccacguacuacugcgcgcgccagaaguucuacgccgggggccaggggugguacuucgaccuguggggccggggcacccugaucguggugagcucc

SEQ ID NO: 11626 - RNA, 372 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucaaguccgagcucauccacugggugcggcaggcgccggggcagggccuggaguggaucgggugggucaagaccgugacgggcgccgugaacuucggcagcuccgacuuccgccagcgggucagccugacccgcgaccgggaccucuucaccgcccacauggacauccgcgggcugacccagggcgacacggccaccuacuucugcgcccggcagaaguucuacgccgggggccaggggugguacuucgaccuguggggccacggcacccucaucgugguguccagc

SEQ ID NO: 11627 - RNA, 375 nt, Artificial Sequence
  derived and/or modified sequence opt1 from anti-HIV-1_HeavyChain
caggcccaccuggagcagagcggcuccggggugaagaagcccggcaccagcguccggguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgcccgcggggaccagggcugguucuucgaccugugggggcacggcacgcucaucgugguguccagc

SEQ ID NO: 11628 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccaggacgacaccgccacguacuacugcgcgcgccagaaguucgcccggggcgaccaggggugguucuucgaccuguggggccgcgggacccugaucguggugagcucc

SEQ ID NO: 11629 - RNA, 381 nt, Artificial Sequence
  derived and/or modified sequence opt1 from anti-HIV-1_HeavyChain
caggugcagcugguccagagcggcgccgaggugaagaagcccggggccuccgugaaggucagcugcaaggcguccggcuacaccuucaccgacuacuaccuccacugggugcgccaggccccggggcagggccuggacugggugggguggaucaaccccaacagcggcggcacgaacuacgcccagaaguuccaggggcgggucgccaugacccgcgacaccucccugagcuccguguaccucgaccugaacagccugaccuccgccgacagcggcacguacuucugcgcgcggcagaccuucaagcccgacuucuacuucgccgaccaggggugguccuucaaccucuggggccaggggagccacuucaucguguccagc

SEQ ID NO: 11630 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagaaguccgagcucauccacugggugcggcgcgcgccggggcagggccuggaguggaucgggugggucaagaccgugacgggcgccgugaacuucggcagcuccgacuuccggcagcgcgucagccugacccgggaccgcgaccucuucaccgcccacauggacauccgggggcugacccagggcgacacggccaccuacuacugcgcccgccagaaguucuacgccgggggccaggggugguacuucgaccuguggggccggggcacccucaucgugguguccagc

SEQ ID NO: 11631 - RNA, 372 nt, Artificial Sequence
  derived and/or modified sequence opt1 from anti-HIV-1_HeavyChain
caggcgcaccuggagcagagcggcuccggggugaagaagcccggcgccagcgucaccguguccugcuggaccagcgaggacaucuucgagaaguccgagcucauccacugggugcgccaggcgccggggcagggccuggaguggaucgggugggucaagacggugaccggcgccgugaaccuggucuaccagaucagcgaccgggugucccucacccgcgaccggggccuguucaccgcccacauggacauccgcgggcugacgcagggcgacaccgccaccuacuacugcgcccggcagaaguucuacgccgggggccaggggugguacuucgaccucuggggccgcggcacccugaucguggucagcucc

SEQ ID NO: 11632 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagggguccgagcucauccacugggugcggcaggcgccgggccaggggcuggaguggaucggcugggucaagaccgugacgggcgccgugaacuucgggagcgccuacuuccgccaccgggucucccugacccgcgaccgggaccucuucaccgcccacauggacauccgcggccugacccagggggacacggccaccuacuucugcgcgcggcagaaguucuacaagggcgggcagggcugguacuucgaccuguggggccacgggacccucaucguggugagcucc

SEQ ID NO: 11633 - RNA, 375 nt, Artificial Sequence
  derived and/or modified sequence opt1 from anti-HIV-1_HeavyChain
caggcgcaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuacggcucccugaacuuccggagccgcaucucccucacccgggaccgcgaccuguucaccgcccacauggacauccgggggcugacggagggcgacaccgccaccuacuucugcgcccgccagaaguucuacgccgggggccaggggugguacuucgaccucuggggccacggcacccugaucgucgugagcucc

SEQ ID NO: 11634 - RNA, 375 nt, Artificial Sequence
  derived and/or modified sequence opt1 from anti-HIV-1_HeavyChain
caggcccaccuggagcagagcggcuccggggugaagaagcccggcgccagcguccggguguccugcuggaccagcgaggacaucuucgagcggaccgagcucauccacugggugcgccaggcgccggggcagggccuggaguggaucgggugggucaagacgguguccggcgccgugaacuucggcagccccaacuuccggcaccgcgucucccugacccgggaccgcgaccucuucaccgcccacauggacauccgggggcugacccagggcgacauggccacguacuucugcgcccgccagaaguucgagcgcgggggccaggggugguacuucgaccuguggggccacggcacccucaucguggugagcucc

SEQ ID NO: 11635 - RNA, 375 nt, Artificial Sequence
  derived and/or modified sequence opt1 from anti-HIV-1_HeavyChain
caggcccaccuggagcagagcggcuccggggugaaggagcccggcaccagcguccgcguguccugcuggaccagcgaggacaucuucgagcggacggagcucauccacugggugcgccaggccccggggcagggccuggaguggaucgggugggucaagaccgugaccggcgcggugaacuucggcucccccaacuuccggcaccgcgucagccugacccgggaccgcgaccucuucacggcccacauggacauccgggggcugacccagggcgacaccgccaccuacuucugcgcccgccagaaguucgagcgcgggggccagggguggaucuucgaccuguggggccggggcacgcucaucgccguguccagc

SEQ ID NO: 11636 - RNA, 375 nt, Artificial Sequence
  derived and/or modified sequence opt1 from anti-HIV-1_HeavyChain
caggugcagcuggagcagagcggcuccggggucaagaagcucggcgccagcgugcgcguguccugcuggaccagcgaggacaucuucgggcggaccgagcugauccacuggguccgccaggcccccggccaggggcuggaguggaucggcugggugaaggcgguguccggcgccgucaacuacgggagccucgacuuccggcaccgcgugucccugacgcgggaccgcgaccuguucaccgcccacauggacauccggggccucacccaggacgacaccgccacguacuacugcgcccgccagaaguucgcgcgcggggaccagggcugguucuucgaccugugggggcggggcacccugaucguggucagcucc

SEQ ID NO: 11637 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgacgacaucuucaagaccgagcucauccacugggugcggcaggcgccggggcagggccuggaguggaucgggugggucaagacggugaccggcgccgugaacuucggcucccccaacuuccgccagcgggucagccugacccgcgaccgggaccucuucaccgcccacauggacauccgcgggcugacgcaggacgacaccgccaccuacuucugcgcccggcagaaguucgcgcgcggcgaccaggggugguucuucgaccuguggggccgggggacccucaucgugguguccagc

SEQ ID NO: 11638 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagcggaccgagcucauccacugggugcgccaggcgccggggcagggccuggaguggaucgggugggucaagacggugaccggcgccgugaacuucggcucccccaacuuccggcaccgcgucagccugacccgggaccgcgaccucuucaccgcccacauggacauccgggggcugacgcagggcgacaccgccaccuacuacugcgugcgccagaaguucgagcgcgggggccaggggugguacuucgaccuguggggccggggcacccucaucguggucuccagc

SEQ ID NO: 11639 - RNA, 375 nt, Artificial Sequence
  derived and/or modified sequence opt1 from anti-HIV-1_HeavyChain
caggugcagcugguccagagcggcgccgaggugaagaagcccggggccuccgugaaggucagcugcuggaccuccgaggacaucuucgagaaguccgagcucauccacugggugcgccaggcgccgggccaggggcuggaguggaucggcugggugaagaccgucacgggggccgugaacuucggcagcagcgacuuccggcagcgcgugucccugacccgggaccgcgaccucuucaccgcccacauggacauccggggccugacccagggggacacggccaccuacuacugcgcccgccagaaguucuacgcgggcgggcagggcugguacuucgaccugugggggcggggcacccucaucgucgugagcucc

SEQ ID NO: 11640 - RNA, 375 nt, Artificial Sequence
  derived and/or modified sequence opt1 from anti-HIV-1_HeavyChain
caggcccaccuggagcagagcggcuccggggugaagaagcucggcgccagcguccgcguguccugcuggaccagcgaggacaucuucgagcggaccgagcugauccacugggugcgccaggcgcccgggcagggccuggaguggaucgggugggucaaggccguguccggcgccgugaacuacggcagccucgacuuccggcaccgcgucucccugacgcgggaccgcgaccuguucaccgcccacauggacauccgggggcucacccagggcgacaccgccacguacuucugcgcgcgccagaaguucuacaagggcgggcaggggugguacuucgaccuguggggccggggcacccugaucguggugagcucc

SEQ ID NO: 11641 - RNA, 372 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgagaaguccgagcucauccacugggugcggcaggcgccggggcagggccuggaguggaucgggugggucaagaccgugacgggcgccgugaacuucgcccaccagaucagcgaccgcgucucccugacccgggaccgcgaccucuucaccgcccacauggacauccggggccugacccagggggacacggccaccuacuacugcgcgcgccagaaguucuacgccggcgggcagggcugguacuucgaccugugggggcggggcacccucaucguggugagcucc

SEQ ID NO: 11642 - RNA, 375 nt, Artificial Sequence
  derived and/or modified sequence opt1 from anti-HIV-1_HeavyChain
caggcccaccuggagcagagcggcuccggggugaagaagcccggcgccagcguccgcguguccugcuggaccagcgaggacaucuucgggcggaccgagcucauccacugggugcgccaggcgccgggccaggggcuggaguggaucggcugggucaagacgguguccggcgccgugaacuucgggagccccaacuuccggcaccgcgucucccugacccgggaccgcgaccucuucaccgcccacauggacauccggggccugacccagggggacacggccaccuacuucugcgcccgccagaaguucgagcggggcgggcagggcugguacuucgaccuguggggccgcgggacccucaucugcgugagcucc

SEQ ID NO: 11643 - RNA, 636 nt, Artificial Sequence
  derived and/or modified sequence opt1 from anti-HIV_5CIN_LightChain
gagaucgugcugacccagagccccggcacccagucccucagcccgggggagcgcgccacgcuguccugccgggccagccaguccgucggcaacaacaagcuggcgugguaccagcagcgccccgggcaggcgccccggcuccugaucuacggcgccagcucccgccccagcgggguggccgaccgguucuccggcagcggcuccgggaccgacuucacccugaccaucagccgccucgagccggaggacuucgccguguacuacugccagcaguacggccagucccugagcacguucgggcagggcaccaaggucgaggugaagcggaccguggccgcccccuccgucuucaucuucccgcccagcgacgagcagcugaaguccgggaccgccagcguggugugccuccugaacaacuucuacccccgcgaggccaagguccaguggaagguggacaacgcgcugcaguccggcaacagccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgg

SEQ ID NO: 11644 - RNA, 672 nt, Artificial Sequence
  derived and/or modified sequence opt1 from anti-HIV_5CIN_HeavyChain
gugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggguccggcgggaagccgaucggcgccuucgcccacuggggccaggggacccuggugaccgugagcuccgcgagcaccaagggccccuccgucuucccccuggcccccagcuccaagagcacguccgggggcaccgccgcccucggcugccuggugaaggacuacuucccggagcccgugaccgucagcuggaacagcggggcccugaccuccggcgugcacacguuccccgcggugcuccagagcuccgggcuguacagccuguccagcgucgugaccgugcccuccagcucccucggcacccagaccuacaucugcaacgucaaccacaagccgagcaacacgaagguggacaagaagguggagccc

SEQ ID NO: 11645 - RNA, 678 nt, Artificial Sequence
  derived and/or modified sequence opt1 from anti-HIV_5CIL_HeavyChain
gugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggggacggcgaccuggggaagccgaucggcgccuucgcccacuggggccaggggacccuggugaccguguccagcgcguccaccaagggccccagcgucuucccccucgcccccuccagcaaguccacgagcgggggcaccgccgcccugggcugccuggugaaggacuacuucccggagcccgugaccgucuccuggaacagcggggcccucaccagcggcgugcacacguuccccgcggugcugcaguccagcgggcuguacucccucagcuccgucgugaccgugcccagcuccagccugggcacccagaccuacaucugcaacgucaaccacaagccguccaacacgaagguggacaagaagguggagccc

SEQ ID NO: 11646 - RNA, 678 nt, Artificial Sequence
  derived and/or modified sequence opt1 from anti-HIV_5CIP_A-Chain
gugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggguggggcuggcuggggaagccgaucggcgccuucgcccacuggggccaggggacccuggugaccguguccagcgcguccaccaagggccccagcgucuucccccucgcccccuccagcaaguccacgagcgggggcaccgccgcccugggcugccuggugaaggacuacuucccggagcccgugaccgucuccuggaacagcggggcccucaccagcggcgugcacacguuccccgcggugcugcaguccagcgggcuguacucccucagcuccgucgugaccgugcccagcuccagccugggcacccagaccuacaucugcaacgucaaccacaagccguccaacacgaagguggacaagaagguggagccc

SEQ ID NO: 11647 - RNA, 681 nt, Artificial Sequence
  derived and/or modified sequence opt1 from anti-HIV_5CIP_HeavyChain
gugcagcugguccagagcggcgccgaggugaagcgccccggguccagcgugaccgucuccugcaaggccagcggcggguccuucagcaccuacgcgcucuccugggugcggcaggccccgggccgcgggcuggaguggaugggcggcgugaucccccugcucacgaucaccaacuacgcgccccgguuccaggggcgcaucaccaucaccgccgaccggagcacguccaccgccuaccuggagcugaacagccuccgccccgaggacaccgccgucuacuacugcgcccgggagggcaccacgggguggggcuggcuggggaagccgaucggcgccuucgcccacuggggccaggggacccuggugaccguguccagcgcguccaccaagggccccagcgucuucccccucgcccccuccagcaaguccacgagcgggggcaccgccgcccugggcugccuggugaaggacuacuucccggagcccgugaccgucuccuggaacagcggggcccucaccagcggcgugcacacguuccccgcggugcugcaguccagcgggcuguacucccucagcuccgucgugaccgugcccagcuccagccugggcacccagaccuacaucugcaacgucaaccacaagccguccaacacgaagguggacaagaagguggagcccaag

SEQ ID NO: 11648 - RNA, 630 nt, Artificial Sequence
  derived and/or modified sequence opt1 from anti-HIV_4JKP_LightChain
gagaucgugcugacccagagccccgccacccucucccugagcccgggcgagacggccaucaucuccugccgcaccagccaguacgggucccuggcgugguaccagcagcggcccggccaggcgccccgccucgucaucuacagcggguccacccgggccgccggcauccccgaccgcuucagcgggucccgguggggcgccgacuacaaccugagcaucuccaaccuggagagcggcgacuucgggguguacuacugccagcaguacgaguucuucggccaggggaccaaggugcaggucgacaucaagcgcacgguggccgccccguccguguucaucuucccgcccagcgacgagcagcucaaguccggcaccgccagcgucgugugccugcugaacaacuucuacccccgggaggccaaggugcaguggaaggucgacaacgcgcuccaguccgggaacagccaggaguccgugaccgagcaggacagcaaggacagcaccuacucccugagcuccacgcugacccucagcaaggccgacuacgagaagcacaagguguacgccugcgaggucacccaccagggccuguccagccccgugaccaaguccuucaaccgcggcgagugc

SEQ ID NO: 11649 - RNA, 678 nt, Artificial Sequence
  derived and/or modified sequence opt1 from anti-HIV_3TNN_E-Chain
gaggugcagcuggucgagagcggcgggggccucgugcagcccgggggcucccugcgccugagcugcgccgccuccggguucaccuucagcaccuacgcgauguccugggugcggcaggccccgggcaagggccucgagugggucagcuccaucaacaacagcgggcgcaacacguucuccgccgacagcgugaagggccgguucaccaucucccgcgacaacagcaagaacacccuguuccuggugaugaacucccuccgggccgaggacaccgccgucuacuacugcgcgaaggaccugcgccucgggggcgggagcgacuacuggggccagggcacgcuggugaccguguccagcgccuccaccaaggggcccagcgucuucccccuggcccccuccagcaagagcaccuccggcgggacggccgcgcugggcugccucgugaaggacuacuucccggagcccgugaccgucagcuggaacuccggcgcccugaccagcggggugcacaccuuccccgccgugcugcaguccagcggccucuacucccugagcuccgucgugacggugcccagcuccagccuggggacccagaccuacaucugcaacgucaaccacaagccguccaacaccaagguggacaagcggguggagcccaagagcugcgacaagacgcac

SEQ ID NO: 11650 - RNA, 705 nt, Artificial Sequence
  derived and/or modified sequence opt1 from anti-HIV_3BQU_B-Chain
cgcaucacccugaaggagagcgggcccccgcucgugaagcccacccagacgcugacccugaccugcuccuucagcggguucucccucagcgacuucggcgucggggugggcuggauccggcagccgcccgggaaggcccuggaguggcuggccaucaucuacuccgacgacgacaagcgcuacagccccucccucaacacccggcugacgaucaccaaggacaccagcaagaaccaggugguccuggugaugacccgcgugucccccgucgacacggcgaccuacuucugcgcccaccggcgcggccccaccacccucuucggcgugcccaucgcccgggggccggugaacgccauggacgucuggggccaggggaucacggugaccaucagcuccaccagcaccaagggccccuccguguucccccuggcccccagcuccaagagcacggcgggcggcgccgccgcccugggcugccucgucaaggacuacuucccggagcccgugaccguguccuggaacagcggggcgcugaccuccggcguccacaccuuccccgccgugcugcagagcagcgggcucuacucccugagcuccguggucacggugcccagcuccagccugggcacccagaccuacacgugcaacgugaaccacaagccguccaacaccaaggucgacaagcgcguggagcccaagagcugc

SEQ ID NO: 11651 - RNA, 642 nt, Artificial Sequence
  derived and/or modified sequence opt1 from anti-HIV_3BQU_A-Chain
gcccugcagcucacgcagagccccuccagccuguccgccagcgugggcgaccgcaucaccaucacgugccgggcgucccagggggucaccagcgcccuggccugguaccgccagaagccgggcuccccgccccagcuccugaucuacgacgccagcucccuggagagcggggugcccucccgguucagcggcuccgggagcggcaccgaguucacccucacgaucuccacccugcgccccgaggacuucgccaccuacuacugccagcagcugcacuucuacccccacaccuucggcgggggcacgcggguggacguccgccggaccguggcggcccccagcguguucaucuucccgcccuccgacgagcagcucaagagcgggaccgccuccgucgugugccugcugaacaacuucuacccccgcgaggccaaggugcaguggaaggucgacaacgcgcuccagagcggcaacagccaggaguccgugaccgagcaggacagcaaggacuccacguacagccuguccagcacccugacccucuccaaggccgacuacgagaagcacaagguguacgagugcgaggucacccaccaggggcugagcucccccgugaccaagagcuucaaccggggcgagugc

SEQ ID NO: 11652 - RNA, 387 nt, Artificial Sequence
  derived and/or modified sequence opt1 from anti-HIV_IgG_VR-Chain
auggagacccccgcccagcuccuguuccugcugcuccuguggcugccggacaccacgggcgagaucgugcucacccagagccccgggacccugucccugagcgccggcgagcgcgcgacccucuccugccgggccagccaguccgucagcucccgcuaccuggccugguaccagcagaagcccgggcaggcgccccggcugcucaucuacggcgccagcucccgcgccacggggaucccggaccgguucagcggcuccggcagcgggaccgacuucacccugaccaucucccgcguggagcccgaggacuucgccggcuacuacugccagcaguacgacaacagcgugugcacguucgggcagggcaccaagcuggagaucaagcgg

SEQ ID NO: 11653 - RNA, 348 nt, Artificial Sequence
  derived and/or modified sequence opt1 from anti-HIV_IgG_HeavyChain
augaagcaccugugguucuuccuccugcugguggccgcgccccgcuggguccucagccaggugcagcugcaggaguccggcccggggcuggugaagcccagcgagacccucucccugaccugcacggucagcggcggguccaucagcucccacuacuggagcuggauccggcagucccccggcaaggggcugcaguggaucggcuacaucuacuacagcggcuccaccaacuacagccccucccucaagagccgcgugaccaucuccguggagaccagcaagaaccaguucucccugaagcugacgagcaugaccgccgccgacaccgccgucuacuacugcgcccgg

SEQ ID NO: 11654 - RNA, 714 nt, Artificial Sequence
  derived and/or modified sequence opt1 from anti-HIV_4P9M_HeavyChain
cagauccaccuggugcagagcggcaccgaggucaagaagcccggguccagcgugaccguguccugcaaggccuacggcgucaacacguucgggcucuacgccgugaacugggugcgccaggcgccgggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgacaagugguccgggcuccaccacgacggcgucauggccuucagcuccugggggcagggcacgcugaucagcguguccgcggccagcaccaaggggcccagcguguucccccuggcccccuccagcaaguccaccagcggcggcaccgccgcgcucgggugccuggucaaggacuacuuccccgagcccgugacgguguccuggaacagcggcgcccugaccuccgggguccacaccuucccggccgugcuccagagcuccggccuguacagccuguccagcguggucaccgugcccuccagcucccucggcacgcagaccuacaucugcaacgugaaccacaagcccagcaacaccaaggucgacaagcgcguggagcccaaguccugcgacaagacc

SEQ ID NO: 11655 - RNA, 645 nt, Artificial Sequence
  derived and/or modified sequence opt1 from anti-HIV_4P9M_LightChain
gacauccagaugacgcagagccccuccacccugagcgccuccaucggcgacacggugcgcaucagcugccgggccucccagagcaucaccgggaacugggucgcgugguaccagcagcgcccgggcaaggcgccccggcuccugaucuaccgcggggccgcccugcucggcggggugcccucccgguucagcggcuccgccgccggcaccgacuucacccugacgaucgggaaccugcaggccgaggacuucggcaccuucuacugccagcaguacgacaccuaccccgggaccuucggccaggggacgaagguggaggucaagcgcaccguggccgccccgagcguguucaucuucccgcccuccgacgagcagcucaagagcggcaccgcguccgucgugugccugcugaacaacuucuacccccgggaggccaaggugcaguggaaggucgacaacgcccuccagagcggcaacucccaggagagcgugaccgagcaggacuccaaggacagcacguacucccugagcagcacccugacccucuccaaggccgacuacgagaagcacaagguguacgccugcgaggucacccaccaggggcugagcucccccgugaccaagagcuucaaccgcggcgagugc

SEQ ID NO: 11656 - RNA, 558 nt, Artificial Sequence
  derived and/or modified sequence opt1 from anti-HIV_4P9H_C-Chain
aagaaggugguccugggcaagaagggggacaccguggagcugaccugcacggccagccagaagaaguccauccaguuccacuggaagaacagcaaccagaucaagauccugggcaaccagggguccuuccugaccaagggccccagcaagcucaacgaccgcgccgacucccggcgcagccugugggaccaggggaacuucccgcugaucaucaagaaccucaccaucgaggacuccgacaccuacaucugcgagguggaggaccagaaggaggagguccagcugcugguguucggccucacggcgaacagcgacacccaccuccugcagggccagucccucacccugacccuggagagcccgcccggguccagccccuccgugcagugccggagcccccgcggcaagaacauccagggcgggaagacgcucuccgucagccagcuggagcugcaggacuccgggaccuggaccugcaccgugcuccagaaccagaagaagguggaguucaagaucgacaucgucgugcuggccuuccagaaggccaucgacggccgg

SEQ ID NO: 11657 - RNA, 462 nt, Artificial Sequence
  derived and/or modified sequence opt1 from anti-HIV_4YBL_A-Chain
gugcccgucuggaaggacgccgacaccacccuguucugcgccagcgacgcgaaggcccacgagacggagugccacaacgugugggccacccacgccugcgugccgaccgaccccaacccccaggagauccaccucgagaacgucaccgagaacuucaacauguggaagaacaacaugguggagcagaugcaggaggacgugaucucccugugggaccagugccugcagcccggcggggccccgaagaucagcuucgaccccauccccauccacuacugcacgcccgcgggcuacgucauccucaagugcaacgacaagaacuucaacgggaccggcccgugcaagaacguguccagcgugcagugcacccacgggaucaagcccgucguguccagcggcggcgggaacaucaaggacaacuggcgcuccgagcuguacaaguacaaggugguccagaucgag

SEQ ID NO: 11658 - RNA, 1056 nt, Artificial Sequence
  derived and/or modified sequence opt1 from anti-HIV_4R4N_V-Chain
aucuggaaggacgccaacaccacccuguucugcgccagcgacgcgaaggccuacgacacggaggugcacaacgucugggccacccacgccugcgugcccaccgacccgagcccccaggagcucaagauggagaacgugaccgaggaguucaacauguggaagaacaacauggucgagcagaugcacacggacaucaucucccugugggaccagucccugaagcccugcgugcagcucaccggcgggagcgcccugacccaggcgugccccaaggugaccuucgagccgauccccauccacuacugcgcccccgccggcuacgccauccugaagugcaacgacaaggaguucaacgggacgggccucugcaagaacgucuccaccgugcagugcacccacgggauccgccccguggucagcacccagcugcugcucaacggcucccuggcggagggcaaggugaugauccggagcgagaacaucacgaacaacgugaagaacaucaucguccagcugaacgaguccgugaccaucaacugcacccgcccgaacaacgggggcagcggguccggcggggacauccggcaggcccacugcaacgugagcggcucccaguggaacaagacccuccaccaggucguggagcagcugcgcaaguacuggaacaacaacacgaucaucuucaacagcuccagcggcggggaccuggagaucaccacccacuccuucaacugcggcggggaguucuucuacugcaacaccagcggccucuucaacuccacgugggugaacggcaccgccagcaucgagaacgggaccaucacccugcccugccggaucaagcagaucaucaacauguggcagcgcgucggccaggccaucuacgccccgcccauccagggggugauccggugcgugagcaacaucacgggccugauccucacccgcgacgggggcggcaacuccaacgagaacgagaccuuccggcccgggggcggggacaugcgcgacaacuggcggagcgagcuguacaaguacaaggucgugaagaucgag

SEQ ID NO: 11659 - RNA, 1065 nt, Artificial Sequence
  derived and/or modified sequence opt1 from anti-HIV_4JKP_G-Chain
guguggaaggacgccgacaccacccuguucugcgccagcgacgcgaaggcccacgagacggagugccacaacgucugggccacccacgccugcgugcccaccgaccccaacccccaggagauccaccucgagaacgugaccgagaacuucaacauguggaagaacaacauggucgagcagaugcaggaggacgugaucucccugugggaccagugccugcagcccugcgugaagcucacgggcgggagcgucaucaagcaggccugccccaagaucuccuucgacccgauccccauccacuacugcacccccgcgggcuacgugauccugaagugcaacgacaagaacuucaacgggaccggccccugcaagaacgugagcuccguccagugcacccacgggaucaagccgguggugagcacgcagcugcuccugaacggcucccuggccgaggaggagaucaucauccgcagcgagaaccucaccaacaacgccaagaccaucaucguccaccugaacaaguccguggagaucaacugcacccggcccagcaacggcggguccggcagcgggggcgacauccgcaaggccuacugcgagaucaacgggacgaaguggaacaaggugcugaagcaggucaccgagaagcucaaggagcacuucaacaacaagaccaucaucuuccagccgcccuccggcggcgaccuggagaucaccaugcaccacuucaacugccgcggggaguucuucuacugcaacacgacccagcuguucaacaacacgugcaucggcaacgagaccaugaaggggugcaacggcaccaucacccuccccugcaagaucaagcagaucaucaacauguggcagggcaccgggcaggcgauguacgccccgcccaucgacggcaagaucaacugcgugagcaacaucaccgggauccugcugacgcgggacggcggggccaacaacaccuccaacgagaccuuccggcccggcggcgggaacaucaaggacaacuggcgcagcgagcucuacaaguacaaggugguccagaucgagggcucc

SEQ ID NO: 11660 - RNA, 723 nt, Artificial Sequence
  derived and/or modified sequence opt1 from anti-HIV_3BQU_D-Chain
augggcuggagcuggaucuuccuguuccuccuguccgggaccgccggcgugcacagcgggguccagcugcagcaguccggccccgagcucgugaagccgggggccagcgugaagauguccugcaaggcgagcggcuacuccuucaccgacuacuucaugcacugggucaagcagagccacggcaagucccuggacuggaucggguacaucaacugcuacacgggcgccaccaacuacagccagaaguucaaggggaaggccaccuucaccguggacacguccagcaacaccgccuacaugcaguucaacucccugaccagcgaggacuccgccguguacuacugcgcgcgcaccagcaucggcuacggguccagcccgcccuuccccuacuggggccagggcacgcucgucaccguguccgccgccaagaccaccccgcccagcguguacccccuggcccccgggagcgcggcccagacgaacuccauggucacccugggcugccucgugaagggguacuuccccgagcccgugaccgucaccuggaacagcggcucccugagcuccggcgugcacacguuccccgccgugcugcagagcgaccucuacacccuguccagcuccgucaccgugcccagcuccccgcggcccagcgagaccgugacgugcaacgucgcccaccccgccuccagcaccaagguggacaagaagaucgugccccgc

SEQ ID NO: 11661 - RNA, 699 nt, Artificial Sequence
  derived and/or modified sequence opt1 from anti-HIV_3BQU_C-Chain
augaccauguucagccuggcccuccugcugucccuccugcugcucugcgugagcgacuccggcgccgagaccacggugacccagagccccgcgucccugagcauguccaucggggagaaggugaccauccgcugcaucaccagcacggacaucgacgacgacaugaacugguaccagcagaagccgggcgagccgccccggcugcucaucuccgacgggaacacccugcgccccggcgugcccagccgguucuccagcuccggguacggcaccgacuucgucuucaccaucgagaacaugcugagcgaggacguggccgacuacuacugccuccaguccgacaaccugcccuacacguucggcgggggcaccaaccuggagaucaagcgcgccgacgccgcccccaccgugagcaucuucccgcccuccagcgagcagcucaccuccgggggcgcgagcgucgugugcuuccugaacaacuucuaccccaaggacaucaacgugaaguggaagaucgacgggagcgagcggcagaacggcguccugaacuccuggacggaccaggacagcaaggacuccaccuacagcauguccagcacccucacccugacgaaggacgaguacgagcgccacaacuccuacacgugcgaggccacccacaagaccagcaccucccccaucgucaagagcuucaaccgg

SEQ ID NO: 11662 - RNA, 333 nt, Artificial Sequence
  derived and/or modified sequence opt1 from anti-HIV_Ig_LightChain
gacgugguccugacccagagccccgccucccucgccgugagccugggccagcgcgcgaccaucuccugcaaggccagccaguccguggacuacgacggggacagcuacaugaacugguaccagcagaagcccggccagccgcccaagcugcucauccacgccgccuccaaccuggucagcgggaugcccgcccgguucuccggcagcggguccggcacggacuucacccugaacauccaccccguggaggaggaggacgcggccaccuacuacugccagcagagcaucgaggacccgcccaccuucggcgggggcacgaagcucgagaucaag

SEQ ID NO: 11663 - RNA, 342 nt, Artificial Sequence
  derived and/or modified sequence opt1 from anti-HIV_Ig_HeavyChain
gacgugcagcugcagcagagcggccccgggcucgucaagccgucccagagccugucccacacgugcaccgugaccggcuacagcaucaccuccgacuacgccuggaacuggauccgccaguuccccgggaacaagcuggaguggaugggcuacaucagcuucuccgggagcaccuccuacaaccccagccucaagucccggaucagcaucacccgcgacacguccaagaaccuguucuuccugcagcucaacagcgugaccaccgaggacaccgccacguacuacugcgcgcggggccugcccgacuacuggggccaggggaccacccugaccgucuccagc

SEQ ID NO: 11664 - RNA, 1083 nt, Artificial Sequence
  derived and/or modified sequence opt1 from anti-HIV_4P9H_G-Chain
guguggaaggacgccgacaccacccuguucugcgccagcgacgcgaaggcccacgagacggagugccacaacgucugggccacccacgccugcgugcccaccgaccccaacccccaggagauccaccucgagcaggucaccgagaacuucaacauguggaagaacaacaugguggagcagaugcaggaggacgugaucucccugugggaccagugccugcagcccugcgugaagcucacgggcgggagcgucaucaagcaggccugccccaagaucuccuucgacccgauccccauccacuacugcacccccgcgggcuacgugauccugaagugcaacgacaagaacuucaacgggaccggccccugcaagaacgugagcuccguccagugcacccacgggaucaagccgguggugagcacgcagcugcuccugaacggcucccuggccgaggaggagaucaucauccgcagcgagaaccucaccaacaacgccaagaccaucaucguccaccuccagaaguccguggagaucaacugcacccggcccagcaacggcggguccggcagcgggggcgacauccgcaaggccuacugcgagauccaggggacgaaguggaacaaggugcugaagcaggucaccgagaagcugaaggagcacuucaacaacaagaccaucaucuuccagccgcccuccggcggcgaccuggagaucaccaugcaccacuucaacugccgcggggaguucuucuacugcaacacgacccagcuguuccagaacacgugcaucggcaacgagaccaugaaggggugcaacggcaccaucacccuccccugcaagaucaagcagaucaucaacauguggcagggcaccgggcaggcgauguacgccccgcccaucgacggcaagaucaacugcgugagccagaucaccgggauccugcugacgcgggacggcggggccaacaacaccuccaacgagaccuuccggcccggcggcgggaacaucaaggacaacuggcgcagcgagcucuacaaguacaaggugguccagaucgagggcucccaccaccaccaccaccac

SEQ ID NO: 11665 - RNA, 147 nt, Artificial Sequence
  derived and/or modified sequence opt1 from anti-HIV_Chain
caggugcagcugguccagagcggcgggcagaugaagaagcccggcgaguccaugcgcaucagcugccgggccuccggguacgaguucaucgacugcacccucaacuggauccgccuggccccgggcaagcggcccgaguggaugggg

SEQ ID NO: 11666 - RNA, 180 nt, Artificial Sequence
  derived and/or modified sequence opt1 from anti-HIV_Chain
cccugcugcuucgccuacaucgcccgcccgcugccccgggcgcacaucaaggaguacuucuacaccagcggcaagugcuccaaccccgccguggucuucgugacccgcaagaaccgccaggugugcgccaaccccgagaagaaguggguccgggaguacaucaacagccucgagaugucc

SEQ ID NO: 11667 - RNA, 249 nt, Artificial Sequence
  derived and/or modified sequence opt1 from anti-HIV_Chain
cuggaguggaugggccgcaucaucccggccaucgacgacgugaccuacgcccagaccuuccgggggcgcgucacguucagcgcggacaaguucaccaccaccgccuacauggaccucacgggccugcgguccgaggacaccgccaccuacuucugcgcccgcgacccccaggugaaccggcgcgggaacugcuucgaccacuggggccaggggacccuggugacggucagcuccgccagcaccaagggc

SEQ ID NO: 11668 - RNA, 270 nt, Artificial Sequence
  derived and/or modified sequence opt1 from anti-HIV_Chain
gacguggucaugacccagagcccccugucccucccggugacccugggccagcccgccagcaucuccugccgcagcucccagagccugguguacucccacggggacacguaccucaagugcuuccagcagcggcccggccagagcccccgccggccgaucuacaaggucuccaaccgcgacagcggggugcccgaccgguucuccggcagcggguccggcaccgacuucacccugaagaucagccgcguggaggccgaggacgucggcgug

SEQ ID NO: 11669 - RNA, 294 nt, Artificial Sequence
  derived and/or modified sequence opt1 from anti-HIV_Chain
agcuccuucgccaucagcugggugcgccaggcccccggccaggggcuggaguggaugggcgggaucaucccgaucuucgaggcgaccuccuacgcccagaaguuccaggaccggcucaccaucacgaccgacgagagcaccaccacggccuacauggaccuguccagccugcgcuccgaggacaccgccgucuacuacugcgcccgggcgcagggcgacauccucaccgagggguacuucgacuacuggggccagggcacccuggugacggugagcuccgccagcaccaagggg

SEQ ID NO: 11670 - RNA, 297 nt, Artificial Sequence
  derived and/or modified sequence opt1 from anti-HIV_Chain
aacaccuucaccagccacuacgugcacuggguccgccaggcccccggccaggggcuggaguggaugggcaugaucaaccccgggggcacgacccgguacgccccgaaguuccaggaccgcgugacccucacccgggacacguccacccgcaccguguacauggagcugcggagccugcgcuccgaggacaccgcggucuacuacugcgcccggccccaguacaaccucgggcgcgagccccugaacguguggggccagggcacgauggugaccgucagcuccgccagcaccaagggg

SEQ ID NO: 11671 - RNA, 297 nt, Artificial Sequence
  derived and/or modified sequence opt1 from anti-HIV_Chain
auccgcagcuucuacuggcacuggauccggcagucccccggcaaggggcuggaguggcucggcagcguguucgacaacgggcugaccacccacaacccgucccucaagagccgccugacgaucuccgaggaccccagccggaaccagaucucccugaagcugcgcagcaugaccgccgccgacaccgcggucuacuacugcgcccggggcgacuacgacauccucaccuccagcuaccaguucgacuacugggggcagggcacgcugguggccguguccagcgccuccaccaagggc

SEQ ID NO: 11672 - RNA, 300 nt, Artificial Sequence
  derived and/or modified sequence opt1 from anti-HIV_Chain
cagagcgcccugacccagcccgccuucguguccggcagcccggggcaguccaucacccucagcugcacgcugggcaccgaggacgucuccugguaccagcagcgccccaacagcgcgccccggcugaucaucuucgacgugaagaagcgccccuccgacgugagcgaccgguucuccgggcacaacagcgacaccgccgccuuccucaccaucuccgagcugcgcccggaggacgaggccgacuacuucugcacgagcuggcccuaccgguucgaccgcggcaccaaggucgacguggcc

SEQ ID NO: 11673 - RNA, 300 nt, Artificial Sequence
  derived and/or modified sequence opt1 from anti-HIV_Chain
cagagcgcccugacccagcccgccuucguguccggcagcccggggcaguccaucacccucagcugcacgcugggcaccgaggacgucuccugguaccagcagcgccccaacagcgcgccccggcugaucaucuucgacgugaagaagcgccccuccgacgugagcgaccgguucuccgggcacaacagcgacaccgccgccuuccucaccaucuccgagcugcgcccggaggacgaggccgaguacuucugcacgagcuggcccuaccgguucggccgcgggaccaaggucgacguggcc

SEQ ID NO: 11674 - RNA, 300 nt, Artificial Sequence
  derived and/or modified sequence opt1 from anti-HIV_Chain
cagagcgcccugacccaccccgccuucguguccggcagcccggggcaguccaucacccucagcugcacgcugggcaccgaggacgucuccugguaccagcagcgccccaacagcgcgccccggcugaucaucuucgacgugcgcaagcggcccuccgaggugagcgaccgcuucuccgggcacaagagcgacaccgccgccuuccucaccaucuccgaccugcggccggaggacgaggccgaguacuucugcacgagcuggcccuaccgcuucgaccggggcacccgccuggacgucgcc

SEQ ID NO: 11675 - RNA, 300 nt, Artificial Sequence
  derived and/or modified sequence opt1 from anti-HIV_Chain
cagagcgugcugacccagcccgccuucgucuccggcagcccggggcaguccaucaccaucagcugcacggugggcaccaccgacguguccugguaccagcagcgccccaacagcgcgccccggcucaucaucuucgacgucaagaagcgccccuccggggugagcgaccgguucuccggcagcuccagcgacaacgccgccuuccugaccaucgccgggcugcgcccggaggacgaggccgaguacuacugcacguccuggcccuaccgguucggccgcggcaccaagguggacgucggg

SEQ ID NO: 11676 - RNA, 300 nt, Artificial Sequence
  derived and/or modified sequence opt1 from anti-HIV_Chain
cagagcgugcugacccagcccgccuucgucuccgccagcccgggccaguccaucacccucagcugcaaccuggggacggacuacguguccugguaccagcagcgccccagcuccgcgccccggcugaucaucuucgacgugaagaaccgccccagcggcgucuccgaccgguucagcggguacaacuccgacaccgccgccuuccucaccaucagcggccugcagccggaggacgaggccgaguacuacugcaccuccuggcccuacaacuucgggcccggcacgaagguggacgugacc

SEQ ID NO: 11677 - RNA, 300 nt, Artificial Sequence
  derived and/or modified sequence opt1 from anti-HIV_Chain
cagagcgugcugacccagcccgccuccgucagcggcuccccggggcagagcaucaacaucuccugcgccggccgcagcgaccggguguccugguaccagcagcgccccaacggggugcccaagcuccugcuguucgacgucuaccggcgccccagcggcguguccgaccgguucagcgggucccacagcgacgacaccgcguuccucacgaucuccggccugcagaccgacgacgaggccgacuacuacugcaccagccacccguacgccuucggccccgggaccaaggugaacguccug

SEQ ID NO: 11678 - RNA, 300 nt, Artificial Sequence
  derived and/or modified sequence opt1 from anti-HIV_Chain
cagagcgugcugacccagcccgccuucgucuccggcagcccggggcaguccaucacccucagcugcacgcugggcaccgaggacguguccugguaccagcagcgccccaacagcgcgccccggcugaucaucuucgacgugaagaagcgccccuccgacgucagcgaccgguucuccgggcacaacagcgacaccgccgccuuccucaccaucuccgagcugcgcccggaggacgaggccgaguacuucugcacgagcuggcccuaccgguucggccgcgggaccaagguggacguggcc

SEQ ID NO: 11679 - RNA, 306 nt, Artificial Sequence
  derived and/or modified sequence opt1 from anti-HIV_Chain
cagagcgcccugacccagcccgccuccgugagcggcuccccggggcagagcaucaccaucuccugcacggcggacagcgacuacgucuccugguaccagcagcgccccaacagcgcccccaagcucauccuguucgacgugaacucccggcccagcggcguguccgaccgcuacagcgggucccggagcggcaacaccgccucccugaccaucagcgggcuccagcgcgaggacgaggccgacuacuucugcaccccguggcccuacgacuuccggcccggcacgcgcgucuucgugcugggccag

SEQ ID NO: 11680 - RNA, 306 nt, Artificial Sequence
  derived and/or modified sequence opt1 from anti-HIV_Chain
cagagcgcccugacccagcccgccuucguguccggcagcccggggcaguccaucacccucagcugcucccugggcacggcggacgucagcugguaccagcagcgccccaacuccgcgccccggcugaucaucuucgacgugaagaagcgccccagcgacguguccgaccgguucagcgggcacaacuccgacaccgccgccuucgucaccaucagcgagcuccgcccggaggacgaggccgaguacuucugcaccuccuggcccuaccgguucggccccgggacgaagguggacguggcccgccag

SEQ ID NO: 11681 - RNA, 306 nt, Artificial Sequence
  derived and/or modified sequence opt1 from anti-HIV_Chain
cagagcgugcugacccagcccgccuccgucagcggcuccccggggcagaccaucagcaucuccugcagcggcacguucggguccgacagcguguccugguaccagcaguuccccaacagcgcccccacccucaucaucuucgacgugcaccgccggcccuccggcaucagcacccgcuucuccgggagcaccuccggcgacacggcgagccugaccaucuccacccugcaccgggaggacgaggccuucuacuacugcaccagccacccguacgacuucggcgggggcacguacgucaucgugcuc

SEQ ID NO: 11682 - RNA, 306 nt, Artificial Sequence
  derived and/or modified sequence opt1 from anti-HIV_Chain
cagagcgugcugacccagcccgccuccgucagcggcuccccggggcagaccaucagcaucuccugcagcggcacguucggguccgacagcguguccugguaccagcaguaccccaacagcgcccccacccucaucaucuucgacgugcaccgccggcccuccggcaucagcacccgcuucuccgggagcaccuccggcgacacggcgagccugaccaucuccacccugcaccgggaggacgaggccuacuacuacugcaccagccacccguacgacuucggcgggggcacguacgucaucgugcuc

SEQ ID NO: 11683 - RNA, 306 nt, Artificial Sequence
  derived and/or modified sequence opt1 from anti-HIV_Chain
cagagcgcccugacccagcccgccuccgugagcggcuccccggggcagagcaucaacaucuccugcgcgggccgcagcgaccgggucuccugguaccagcagcgccccaacggggugcccaagcuccugauguucgacguguaccggcgccccagcggcgucuccgaccgguucagcgggucccacagcggcgacaccgccuuccugacgaucuccggccuccagaccgaggacgaggccgacuacuacugcaccagccacccguacgccuucggggccggcaccaaggugaacgugcugcgccag

SEQ ID NO: 11684 - RNA, 306 nt, Artificial Sequence
  derived and/or modified sequence opt1 from anti-HIV_Chain
gacauccagaugacccagagccccuccagccuguccgccagcgugggcgaccgcgucuccauccacugccaggccgggcagggcaucgggagcucccucaacugguaccagcagaagccgggccgggcgccccgccugcuggugcacggggccagcaaccuccagcggggcgugcccucccgcuucagcggcuccggguuccacaccacguucacccugaccaucagcucccugcagcccgacgacgucgccaccuacuggugcgccgcccucgaguucuucggcccggggacgaagguggagauc

SEQ ID NO: 11685 - RNA, 309 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgccgaagcugcugaucuacgacggguccaagcucgagcgcggcgugcccagccgguucuccgggcgccgguggggccaggaguacaaccugaccaucaacaaccugcagcccgaggacaucgccaccuacuucugccagguguacgaguucgucgugcccggcacccgccucgaccugaagcggaccguggcc

SEQ ID NO: 11686 - RNA, 309 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgccgaagcugcugaucuacgacgggagcaagcucgagcggggcgugcccgcccgcuucuccgggcggcgcuggggccaggaguacaaccugaccaucaacaaccugcagcccgaggacguggccaccuacuucugccaggucuacgaguucaucgugcccggcacccggcucgaccugaagcgcaccguggcc

SEQ ID NO: 11687 - RNA, 309 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgccgaagcugcugaucuacgacgggagcaagcucgagcggggcgugcccucccgcuucagcgggcggcgcuggggccaggaguacaaccugaccaucaacaaccugcagcccgaggacaucgccaccuacuucugccagguguacgaguucgccguccccggcacccggcucgaccugaagcgcaccguggcc

SEQ ID NO: 11688 - RNA, 309 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgccgaagcugcugaucuacgacggguccaagcucgagcgcggcgugcccagccgguucuccgggcgccgguggggccaggaguacaaccugaccaucaacaaccugcaggccgaggacaucgccaccuacuucugccagguguacgaguucgccguccccggcacccgccucgaccugaagcggaccguggcc

SEQ ID NO: 11689 - RNA, 309 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgccgaagcugcugaucuacgacggguccaagcucgagcgcggcgugcccagccgguucuccgggcgccgguggggccaggaguacaaccugaccaucaacaaccugcagcccgaggacaucgccaccuacuucugccagguguacgaguucaucguccccggcacccgccucgaccugaagcggaccguggcc

SEQ ID NO: 11690 - RNA, 309 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgccgaagcugcugaucuacgacgggagcaagcucgagaccggcgugcccucccgguucaccgggcgccgguggggccaggaguacaaccugaccaucaacaaccugcagcccgaggacaucgccaccuacuucugccagguguacgaguucaucguccccggcacccgccucgaccugaagcggaccguggcc

SEQ ID NO: 11691 - RNA, 312 nt, Artificial Sequence
  derived and/or modified sequence opt1 from anti-HIV_Chain
gacauccagaugacccagagccccuccagccuguccgccagcgugggcgacaaggucaccaucacgugccagaccuccgccggguaccucaacugguaccagcagcgccggggccgcgcgccgaagcugcugauguacgacgggagccggcucgugaccggcgugcccucccgcuucagcgggcggcgcuggggcacccaguacaaccugacgaucggcucccugcagcccgaggacgucgccaccuacuacugccagguguacgaguucuucgggcccggcacccggcucgaccugaagcgcaccguggcc

SEQ ID NO: 11692 - RNA, 312 nt, Artificial Sequence
  derived and/or modified sequence opt1 from anti-HIV_Chain
gacauccagaugacccagagccccuccagccuguccgccagcgugggcgacaaggucaccaucacgugccagaccuccgccggguaccugaacugguaccagcagcgccggggccgcgcgccgaagcugcugauguacgacgggagccggcucgugaccggcgugcccucccgcuucagcgggcggcgcuggggcacccaguacaaccugacgaucggcucccugcagcccgaggacaucgccaccuacuacugccaggucuacgaguucuucgggcccggcacccggcucgaccucaagagcaccguggcc

SEQ ID NO: 11693 - RNA, 312 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgccgaagcugcugaucuacgacgggagcaagcucgagcggggcgugcccgcccgcuucuccgggcggcgcuggggccaggaguacaaccugaccaucaacaaccugcagcccgaggacguggccaccuacuucugccaggucuacgaguucaucgugcccggcacccggcucgaccugaagcgcaccguggccgcc

SEQ ID NO: 11694 - RNA, 312 nt, Artificial Sequence
  derived and/or modified sequence opt1 from anti-HIV_Chain
ugcaccgugagcggcggguccaucaucagcuacuacuggaacuggauccgccagucccccggcaaggggcuggaguggcucggcuacaucuucgacgggggccgggccaacuacaacccgagccugcgcucccggcugaccaugagcgucgacacguccaagaaccagaucagccucaaggugaaguccgugaccgccgcggacagcgccaucuacuacugcgcccgccuggacggcgaggccuuccgguacuacuucgacuccugggggcagggcacccuggucaccgugagcuccgccagcacgaagggg

SEQ ID NO: 11695 - RNA, 312 nt, Artificial Sequence
  derived and/or modified sequence opt1 from anti-HIV_Chain
gugagcggcgggcgcuucuccaacuacggccugagcuggguccggcaggcccccgggcagggccucgaguggauggggcgcaucgugccggccaucaaccgggcgaaguacgcccagaaguuccagggccgcgugauccugaccgccgacaagaucaccgacacggccuacauggagcugcggucccuccgcagcgaggacaccgccaucuucuacugcgcgcgggacccccagaucgagauccgcggcaacgccuucgacaucugggggcagggcaccgucgugaccguguccagcgccuccacgaagggg

SEQ ID NO: 11696 - RNA, 315 nt, Artificial Sequence
  derived and/or modified sequence opt1 from anti-HIV_Chain
agcgacaucuccguggcccccggcgagaccgcccgcaucagcugcggggagaagucccugggcagccgggcgguccagugguaccagcaccgcgccgggcaggccccgucccucaucaucuacaacaaccaggaccggcccagcggcauccccgagcgcuucuccgggagccccgacuccccguucggcaccacggccacccugaccaucaccagcguggaggccggcgacgaggcggacuacuacugccacaucugggacucccgggugcccacgaagugggucuucgggggcgggaccacccugaccgugcuc

SEQ ID NO: 11697 - RNA, 315 nt, Artificial Sequence
  derived and/or modified sequence opt1 from anti-HIV_Chain
agcuccaugagcgugucccccggcgagaccgccaagaucagcugcgggaaggaguccaucggcagccgcgccguccagugguaccagcagaaguccgggcagccgcccagccugaucaucuacaacaaccaggaccggcccuccggcgugcccgagcgcuucagcgcgaccccggacuucggggccggcacgaccgccacccucaccaucacgaacguggaggccgacgacgaggccgacuacuacugccacaucuacgacgcgcggggcgggaccaacugggucuucgaccgcggcgccacccugaccgugcug

SEQ ID NO: 11698 - RNA, 315 nt, Artificial Sequence
  derived and/or modified sequence opt1 from anti-HIV_Chain
agcuucguguccgucgcccccggccagaccgcccgcaucacgugcggggaggagagccugggcucccggagcgugaucugguaccagcagcgcccggggcaggcgcccucccucaucaucuacaacaacaacgaccggcccagcggcauccccgagcgcuucuccgggagcccgggcuccaccuucggcaccaccgccacccugacgaucaccagcguggaggccggggacgaggccgacuacuacugccacaucugggacucccggcgccccaccaacugggucuucggcgaggggaccacgcugaccgugcuc

SEQ ID NO: 11699 - RNA, 315 nt, Artificial Sequence
  derived and/or modified sequence opt1 from anti-HIV_Chain
agcuucguguccgucgcccccggccagaccgcccgcaucacgugcggggaggagagccugggcucccggagcgugaucugguaccagcagcgcccggggcaggcgcccucccucaucauguacaacaaccacgaccggcccagcggcauccccgagcgcuucuccgggagcccgggcuccaccuucggcaccaccgccacccugacgaucaccagcguggaggccggggacgaggccgacuacuacugccacaucugggacucccggcgccccaccaacugggucuucggcgaggggaccacgcugaccgugcuc

SEQ ID NO: 11700 - RNA, 315 nt, Artificial Sequence
  derived and/or modified sequence opt1 from anti-HIV_Chain
gacauccagaugacccagagccccuccagccuguccgccagcgugggcgacaaggucaccaucacgugccagaccuccgccggguaccugaacugguaccagcagcgccggggccgcgcgccgaagcugcugauguacgacgggagccggcucgugaccggcgugcccucccgcuucagcgggcggcgcuggggcacccaguacaaccugacgaucggcucccugcagcccgaggacaucgccaccuacuacugccaggucuacgaguucuucgggcccggcacccggcucgaccucaagagcaccguggccgcc

SEQ ID NO: 11701 - RNA, 315 nt, Artificial Sequence
  derived and/or modified sequence opt1 from anti-HIV_Chain
gacauccagaugacccagagccccuccagccuguccgccagcgugggcgaccgcgucuccaucaacugccaggccgggcagggccucgggagcucccugaacugguaccagcagaagccgggccgggcgcccaagcugcucgugcacggggccagcaaccugcagcgcggcgugcccucccgguucagcggcuccggguuccacaccacguucacccugaccaucagcucccuccagcccgacgacgucgccaccuacuucugcgccgccuuccagugguucggcccggggacgaagguggagaucaagcgcacc

SEQ ID NO: 11702 - RNA, 318 nt, Artificial Sequence
  derived and/or modified sequence opt1 from anti-HIV_Chain
ugcaccgugagcggcggguccaucagcuccgccggcuacuacuggaccuggauccgccagcaccccgggaagggccuggaguucaucggguacaucuacuacaucggcacgaccuacuacaacccgagccucaagucccggcugaccaucagcaucgacaccuccaagaaccaguucagccugaagcucuccagcgucacggccgcggacaccgccaucuacuacugcgcccgcgacuacaccgcccggggccgccacuucuucgacuacugggggcagggcgcccuggugaccguguccagcgcguccacgaagggg

SEQ ID NO: 11703 - RNA, 321 nt, Artificial Sequence
  derived and/or modified sequence opt1 from anti-HIV_Chain
agcucccugccccucagccuggccccgggcgccaccgcgaagauccccugcggggagaagucccgcggcagccgggccgugcagugguaccagcagaagcccgggcaggcccccacccugaucaucuacaacaaccaggaccgcccggccggcgucuccgagcgguacagcgggaaccccgacguggccaucggcgugacggcgacccucaccaucucccgcgucgaggccggcgacgaggccgaguacuacugccacuacugggacagccggucccccaucagcuggguguucgggggcuggacccagcugacggugcug

SEQ ID NO: 11704 - RNA, 321 nt, Artificial Sequence
  derived and/or modified sequence opt1 from anti-HIV_Chain
agcucccugccccucagcguggccccgggcgccaccgcgaagaucgccugcggggagaaguccuucgccagccgcgccguccagugguaccagcagaagcccggccaggcccccgugcugaucaucuacaacaaccaggaccggcccgcggggguguccgagcgcuucagcggcaccccggacgucggguucggcuccacggccacccugaccaucagccggguggaggccggcgacgaggccgacuacuacugccacaagugggacucccgcagcccccucuccuggguguucgggggcgggacccagcugacgguccug

SEQ ID NO: 11705 - RNA, 321 nt, Artificial Sequence
  derived and/or modified sequence opt1 from anti-HIV_Chain
gacauccagaugacccagagccccuccagccuguccgccagcaucggcgaccgcgugaccaucacgugccgggccucccaggacaucgcgaacuaccucaacugguaccagaagaaguccgggaccccgcccaagcugcugaucuucgccgccaccaaccuccaccgcggcgucagcccccgguucaccgggagcggccacgggacgcacuucucccugaccaucaccaacgugcagcacgaggacuucggcaacuacuucugccagcagagcuucgccaccgugggcuccuucgggcagggcacgugggucgacauccgc

SEQ ID NO: 11706 - RNA, 321 nt, Artificial Sequence
  derived and/or modified sequence opt1 from anti-HIV_Chain
gacauccagaugacccagagccccuccagccuguccgccagcaucggcgaccgcgugaccaucacgugccgggccucccaggacaucgcgaacuaccucaacugguaccagaagaaguccgggaccccgcccaagcugcugaucuucgccgccaccaaccuccaccgcggcgucagcccccgguucaccgggagcggccacgggacgcacuucucccugaccaucaccaacgugcagcacgaggacuucggccacuacuucugccagcagagcuucgccaccgugggcuccuucgggcagggcacgugggucgacauccgc

SEQ ID NO: 11707 - RNA, 321 nt, Artificial Sequence
  derived and/or modified sequence opt1 from anti-HIV_Chain
gacauccagaugacccagagccccuccagccuguccgccagcgugggcgaccgcgucaccaucacgugccgggccucccaggacaucgcgaacuaccucaacugguaccagaagaaguccgggaccccgcccaagcugcugaucuucgccgccaccaaccuccaccgcggcgugagcccccgguucagcggguccggcagcgggacccacuucucccugacgaucaccaacgugcaguacgaggacuucgccaacuacuucugccagcacagcuucggcaccaucggcaccuucgggcagggcacgugggucgacauccgc

SEQ ID NO: 11708 - RNA, 321 nt, Artificial Sequence
  derived and/or modified sequence opt1 from anti-HIV_Chain
gacauccagaugacccagagccccuccagccuguccgccagcaucggcgaccgcgugaccaucacgugccgggccucccaggacaucgcgaacuaccucaacugguaccagaagaaguccgggaccccgcccaagcugcugaucuucggcgccaccaaccuccaccacggggucagcccccgcuucagcggcuccgggcacggcacccacuucagccugacgaucaccaacgugcagcacgaggacuucgccaacuacuucugccagcaguccuuccagaccgugggcagcuucgggcagggcaccugggucgacauccgg

SEQ ID NO: 11709 - RNA, 321 nt, Artificial Sequence
  derived and/or modified sequence opt1 from anti-HIV_Chain
gagaucgugcugacccagagccccgccacccucucccugagcccgggcgagacggccaucaucuccugccgcaccagccaguccgggagccuggcgugguaccagcagcggcccggccaggcgccccgccucgucaucuacuccgggagcacccgggccgccggcauccccgaccgcuucuccgggagccgguggggcgccgacuacaaccuguccaucagcaaccuggaguccggcgacuucgggguguacuacugccagcaguacgaguucuucggccaggggaccaaggugcaggucgacaucaagcgcacgguggcc

SEQ ID NO: 11710 - RNA, 321 nt, Artificial Sequence
  derived and/or modified sequence opt1 from anti-HIV_Chain
gacauccagaugacccagagccccuccagccuguccgccagcaucggcgaccgcgugaacaucacgugccaggccucccgggacaccgggagcgcgcucaacugguaccagcagaaggucggccgcccgccccggcugcugaucuccgccgugagcaaccucggggccggcgugcccucccgcuucagcgggcggcgcuccggcacccagagcacccugaccaucaacacgcugcagcccgaggacaucgccaccuacuucugccagcacuacgaguucuucggcccggggaccaaggucgacaucaagcggaccguggcc

SEQ ID NO: 11711 - RNA, 321 nt, Artificial Sequence
  derived and/or modified sequence opt1 from anti-HIV_Chain
gacauccagaugacccagagccccuccagccuguccgccagcgugggcgaccgcgucaccaucacgugccaggccgggcagggcaucggguccagccuccagugguaccagcagaagccgggcaaggcgcccaagcugcuggugcacggggccuccaaccuccaccggggcgugcccagccgcuucuccggcagcggguuccacaccaccuucucccugaccaucagcggccugcagcgggacgacuucgccacguacuucugcgccguccucgaguucuucgggcccggcaccaagguggagaucaagcgcaccguggcc

SEQ ID NO: 11712 - RNA, 324 nt, Artificial Sequence
  derived and/or modified sequence opt1 from anti-HIV_Chain
agcuacgugcgcccccuguccgucgcccucggcgagaccgccagcaucuccugcgggcggcaggcgcugggcagccgcgccgugcagugguaccagcaccggccggggcaggcccccauccugcucaucuacaacaaccaggaccgccccuccggcauccccgagcgguucagcgggaccccggacaucaacuucggcacgcgcgccacccugaccaucuccggcguggaggccggggacgaggcggacuacuacugccacaugugggacagccgguccggcuucagcugguccuucgggggcgccacccgccugacgguccuc

SEQ ID NO: 11713 - RNA, 324 nt, Artificial Sequence
  derived and/or modified sequence opt1 from anti-HIV_LightChain
gacauccugaugacccagagccccucccuccugagcgccuccgugggcgaccgcgucaccaucacgugcaaggccagccaggacguguccaccgcgguggccugguaccagcagaagccggggaaggcccccaagcugcucaucuacugggccagcacccggcacaccggcguccccucccgcuucacggggagcggcuccgggaccgacuucacccugaccaucagccggcugcaggccgaggacuucgcgcucuacuacugccagcagcacuacacgacccccuggaccuucggcggcgggaccaagguggagaucaagcgc

SEQ ID NO: 11714 - RNA, 324 nt, Artificial Sequence
  derived and/or modified sequence opt1 from anti-HIV_LightChain
gacaucgugaugacccagagccccucccugcucagcgccuccgucggcgaccgcgugaccaucacgugcaaggccagccaggacguguccaccgcggucgccugguaccagcagaagccggggaaggcccccaagcugcugaucuacugggccagcacccggcacaccggcgugcccucccgcuucagcggguccggcagcgggacggacuucacccucaccaucuccagccugcagcccgaggacuucgcccuguacuacugccagcagcacuacaccacgccguggaccuucggcggcgggaccaagguggagaucaagcgg

SEQ ID NO: 11715 - RNA, 324 nt, Artificial Sequence
  derived and/or modified sequence opt1 from anti-HIV_Chain
gacauccagaugacccagagccccuccagccuguccgccagcgugggcgacaccgucacgaucaacugccagaccaacaagggguaccucaacugguaccagcagcgccggggccgcgccccgaagcugcugauguacgacggguccaagcucgugaccggcgugcccagccgguucuccgggcgccgguggggcacccaguacaaccugacgaucggcagccugcagcccgaggacaucgcgaccuacuacugccaggucuacgaguucuucgggcccggcacccgccucgaccugaagcggaccguggccgccccguccgac

SEQ ID NO: 11716 - RNA, 333 nt, Artificial Sequence
  derived and/or modified sequence opt1 from anti-HIV_Chain
cugagcgccuacgugggcgaccgcgucaccaucacgugccgggccucccagaacaucaacaccuaccucaacugguaccagcagcgccccgggaaggcgccgaagcugcugaucuacgccgccagcacccuccaguccggcgugcccagccgguucuccgggagcggcuccgggaccgacuucacccugacgaucagcaaccuggagaccgaggacuucgccguguacuacugccagcagaccuacuccagcgucaccuucggccagggcacgaagcucgagacccgccggaccguggccgcgcccuccguguucaucuucccgcccagcgac

SEQ ID NO: 11717 - RNA, 333 nt, Artificial Sequence
  derived and/or modified sequence opt1 from anti-HIV_Chain
gagaucgugcugacccagagccccgccacccucucccugagcccgggcgagcgcgccacgcuguccugccgggcgagccagggggucaacuucguggugugguaccagcagaagcgcggccaggcgccccggcuccugaucuacgggaacuccgaccgcguccccggcgugcccgaccgguucagcgcccgcggguccggcaccgaguucagccuggugaucuccagcgucgagccggacgacuucgcccucuacuacugccaggaguacuccagcacccccuacaacuucggccccgggacccggguggaccgcaagcggacgguggccgcc

SEQ ID NO: 11718 - RNA, 336 nt, Artificial Sequence
  derived and/or modified sequence opt1 from anti-HIV_HeavyChain
gaggugaagcuggaggagagcggcgggggccucguccagcccgggggcucccgcaagcugagcugcgccgccuccggguucaccuucagcuccuucggcaugcacugggugcggcaggcgccggagaagggccuggaguggguggccuacaucagcuccgggagcuccacccuccacuacgccgacacggucaagggccgcuucaccaucagccgggacaaccccaagaacacccuguuccugcagaugaagcuccccucccugugcuacgggcugcucggcagccgcaaccugucccaccggcugcucagccagaacgacacccccaucugccug

SEQ ID NO: 11719 - RNA, 336 nt, Artificial Sequence
  derived and/or modified sequence opt1 from anti-HIV_Chain
gagaucgugcugacccagagccccgccacccucucccugagcccgggcgagcgcgccacgcuguccugccgggcgagccagggggucaacuucguggugugguaccagcagaagcgcggccaggcgccccggcuccugaucuacgggcccuccgaccgcgcccccggcgucccggaccgguucagcgcccgcggguccggcaccgaguucagccuggugaucuccagcguggagcccgacgacuucgcccucuacuacugccaggaguacuccagcacccccuacaacuucggcaccgggacgcgggucgaccgcaagcggaccguggccgccccc

SEQ ID NO: 11720 - RNA, 336 nt, Artificial Sequence
  derived and/or modified sequence opt1 from anti-HIV_Chain
cagacccugagccugaccugcuccgugagcggcggguccaucagcuccgccggcuacuacuggggguggauccgccagcaccccggcaaggggcuggaguggaucggccacaucuacuacagcggcaacacgaacuacaacccgucccucaagagccggcucuccaugagcgucgagaccuccaagaaccaguucagccugaaccuggccuccgugaccgcggccgacaccgccguguacuucugcgcccgcgacuacagcgccgcggggcggcaccucuucgacuccuggggccaggggauccuggucacggugagcuccgccagcaccaagggc

SEQ ID NO: 11721 - RNA, 336 nt, Artificial Sequence
  derived and/or modified sequence opt1 from anti-HIV_LightChain
gacaucgugaugacccagcagacgccccugacccucagcaucaccaucggccagccggccuccaucagcugcaaguccagccagucccugcuggacagcgacgggaagaccuaccucaacuggcugcugcagcgccccggccagucccccaagcggcucaucuacuggaugagcaagcuggacuccgggguccccgaccgcuucaccggcagcggguccggcacggacuucacccugaagaucagccggguggaggccgaggaccucggcguguacuacugcuggcaggggacccacuucccguggaccuucggcgggggcacgaagcuggagcug

SEQ ID NO: 11722 - RNA, 339 nt, Artificial Sequence
  derived and/or modified sequence opt1 from anti-HIV_LightChain
gacaucgugaucacccagagcaccaaguucauguccacgagcgucggcgaccgcguguccaucacgugcaaggccagccaggacguguccaccgccgucgcgugguaccagcagaagcccgggcagagcccgaagcugcucaucuacugggccuccacccggcacaccggcgugcccgaccgcuucaccgggagcggcuccgggaccgacuacacccugacgaucagccgggugcaggccgaggaccuggcccucuacuacugccagcagcacuacaccacccccuggaccuucggcggcgggacgaagcuggagaucaagcgcaccgucgccgcgccc

SEQ ID NO: 11723 - RNA, 339 nt, Artificial Sequence
  derived and/or modified sequence opt1 from anti-HIV_Chain
gacauccagaugacccagagccccuccagccuguccgcccgcgugggcgacaccgucacguucacgugccaggccaacggguaccucaacugguaccagcagcggcgcggcaaggcgccgaagcugcugaucuacgacgggagcaagcucgagcggggcgugcccucccgcuucagcgggcggcgcuggggccaggaguacaaccugaccaucaacaaccugcagcccgaggacaucgccaccuacuucugccagguguacgaguucgccguccccggcacccggcucgaccugaagcgcaccguggccgccccguccguguucaucuuccccagcgac

SEQ ID NO: 11724 - RNA, 339 nt, Artificial Sequence
  derived and/or modified sequence opt1 from anti-HIV_Chain
cagagcgugcugacccagcccgccuccgucagcggcuccccggggcagagcaucaccaucuccugcacgggcaccaacagcgacgugggguacuccuacgugagcugguuccagcagcaccccggcaagguccccaagcuccugaucuacgacgugucccgccggagcuccggggugagcaaccgcuucuccggcagccgguccggcaacaccgccagccugaccaucuccgggcuccgcgcggaggacgaggccgacuacuacugcggcagcuucacgaccucccugacccuggucuucgggggcgggaccaagcucgccgugcuggugagccccagc

SEQ ID NO: 11725 - RNA, 339 nt, Artificial Sequence
  derived and/or modified sequence opt1 from anti-HIV_Chain
agccuguccgccagcgugggcgaccgcgucaccaucacgugccgggccuccgagagcaucuccuucuaccucaacugguaccagcagaagcccgggaaggcgccggagcugcugaucuucgccaccagcacccuccacuccggcgugcccagccgcuucuccgggagcggcuccgggaccgacuucacccugacgaucagcucccugcagcucgaggacuucgccaccuacuacugccagcagagcuccagcacccccuucaccuucggcggcgggacgaagguggagaucaagcggaccgucgccgcccccuccguguucaucuucccgcccagcgac

SEQ ID NO: 11726 - RNA, 342 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgcccaagcugcugaucuacgacggguccaagcucgagcgcggcgugcccagccgguucuccgggcgccgguggggccaggaguacaaccugaccaucaacaaccugcagcccgaggacaucgccaccuacuucugccagguguacgaguucaucguccccggcacccgccucgaccugaagcggaccguggccgccccgagcguguucaucuucccgcccuccgac

SEQ ID NO: 11727 - RNA, 342 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgcccaagcugcugaucuacgacgggagcaagcucgagcggggcgugcccucccgcuucagcgggcggcgcuggggccaggaguacaaccugaccaucaacaaccugcagcccgaggacaucgccaccuacuucugccagguguacgaguucgccguccccggcacccggcucgaccugaagcgcaccguggccgccccguccguguucaucuucccgcccagcgac

SEQ ID NO: 11728 - RNA, 342 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgcccaagcugcugaucuacgacgggagcaagcucgagcggggcgugcccucccgcuucagcgggcggcgcuggggccaggaguacaaccugaccaucaacaaccugcagcccgaggacaucgccaccuacuucugccagguguacgaguucgucgugcccggcacccggcucgaccugaagcgcaccguggccgccccguccgucuucaucuucccgcccagcgac

SEQ ID NO: 11729 - RNA, 342 nt, Artificial Sequence
  derived and/or modified sequence opt1 from anti-HIV_Chain
gacauccagaugacccagagccccuccagccuguccgcccgcgugggcgacaccgucacguucacgugccaggccaacggguaccucaacugguaccagcagcggcgcggcaaggcgcccaagcugcugaucuacgacgggagcaagcucgagcggggcgugcccucccgcuucagcgggcggcgcuggggccaggaguacaaccugaccaucaacaaccugcagcccgaggacaucgccaccuacuucugccagguguacgaguucgccguccccggcacccggcucgaccugaagcgcaccguggccgccccguccguguucaucuucccgcccagcgac

SEQ ID NO: 11730 - RNA, 342 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgcccaagcugcugauguacgacggguccacccucgagcgcggcgugcccgcccgguucagcgggcgccgguggggccaggaguacaaccugaccaucaacaaccugcagcccgaggacguggccaccuacuucugccaggucuacgaguucaucgugcccggcacccgccucgaccugaagcggaccguggccgccccguccgucuucaucuucccgcccagcgac

SEQ ID NO: 11731 - RNA, 342 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgccgaagcugcugaucuacgacggguccaagcucgagcgcggcgugcccagccgguucuccgggcgccgguggggccaggaguacaaccugaccaucaacaaccugcaggccgaggacaucgccaccuacuucugccagguguacgaguucgccguccccggcacccgccucgaccugaagcggaccguggccgcgcccagcguguucaucuucccgcccuccgac

SEQ ID NO: 11732 - RNA, 342 nt, Artificial Sequence
  derived and/or modified sequence opt1 from anti-HIV_Chain
gacauccagaugacccagagccccuccagccuguccgccagcgugggcgacaccgucacguucacgugccaggccaacggguaccucaacugguaccagcagcgccggggcaaggcgcccaagcugcugaucuacgacgggucccgccucgagcggggcgugcccagccgcuucuccgggcggcgcuggggccaggaguacaaccugaccaucaacaaccugcagcccgaggacaucgccaccuacuucugccagguguacgaguucgccguccccggcacccggcucgaccugaagcgcaccguggccgccccgagcguguucaucuucccgcccuccgac

SEQ ID NO: 11733 - RNA, 342 nt, Artificial Sequence
  derived and/or modified sequence opt1 from anti-HIV_Chain
gacauccagaugacccacagccccuccagccuguccgccagcgugggcgacaccgucacgaucacgugccaggccaacggguaccucaacugguaccagcagcgccggggcaaggcgcccaagcugcugaucuacgacggguccaagcucgagaccggcgugcccagccgcuucaccgggcggcgcuggggccaggaguacaaccugaccaucaacaaccugcagcccgaggacaucgccaccuacuucugccagguguacgaguucaucguccccggcacccggcucgaccugaagcgcaccguggccgccccguccguguucaucuucccgcccagcgac

SEQ ID NO: 11734 - RNA, 342 nt, Artificial Sequence
  derived and/or modified sequence opt1 from anti-HIV_Chain
gacauccagaugacccagagccccuccagccuguccgcccgcgugggcgacaccgucacgaucacgugccaggccaacggguaccucaacugguaccagcagcggcgcggcaaggcgcccaagcugcugaucuacgacgggagcaagcucgagaccggcgugcccucccgguucaccgggcgccgguggggccaggaguacaaccugaccaucaacaaccugcagcccgaggacaucgccaccuacuucugccagguguacgaguucaucguccccggcacccgccucgaccugaagcggaccguggccgccccgagcguguucaucuucccgcccuccgac

SEQ ID NO: 11735 - RNA, 342 nt, Artificial Sequence
  derived and/or modified sequence opt1 from anti-HIV_Chain
gacauccagaugacccagagccccuccagccuguccgcccgcgugggcgacaccgucacguucacgugccaggccaacggguaccucaacugguaccagcagcggcgcggcaaggcgcccaagcugcugaucuacgacgggagcaagcucgagcggggcgugcccucccgcuucagcgggcggggcuggggccaggaguacaaccugaccaucaacaaccugcagcccgaggacaucgccaccuacuucugccagguguacgaguucgccguccccgggacccgccucgaccugaagcggaccguggccgccccguccguguucaucuucccgcccagcgac

SEQ ID NO: 11736 - RNA, 342 nt, Artificial Sequence
  derived and/or modified sequence opt1 from anti-HIV_Chain
gacauccagaugacccagagccccuccagccuguccgccagcgugggcgacaccgucacgaucacgugccaggccaacggguaccucaacugguaccagcagcgccggggcaaggcgcccaagcugcugaucuacgacggguccaagcucgagcgcggcgugcccagccgguucuccgggcgccgguggggccaggaguacaaccugaccaucaacaaccugcagcccgaggacaucgccaccuacuucugccagguguacgaguucgucgugcccggcacccgccucgaccugaagcggaccguggccgccccgagcgucuucaucuucccgcccuccgac

SEQ ID NO: 11737 - RNA, 342 nt, Artificial Sequence
  derived and/or modified sequence opt1 from anti-HIV_Chain
agccaguccguggucacccaggagcccagccugaccguguccccgggcgggacggugacccugaccugcggccccagcaccggggccgucacguccggcuucuacccccacugguuccagcagaagcccgggcaggccccgcgcgcgcucaucuacagcaccuccaacaaguacagcuggacccccgcccgguucuccggcagccugcucggcgggaaggccgugcugacccuguccgacgugcagcccgacgacgaggccgaguacuacugccuccugcugcucuacuacggcgggcccuggaucuucggcgggggcacgaagcugaccguccuggugagc

SEQ ID NO: 11738 - RNA, 345 nt, Artificial Sequence
  derived and/or modified sequence opt1 from anti-HIV_Chain
gacauccagaugacccagagccccuccagccuguccgccagcgugggcgacaaggucaccaucacgugccagaccuccgccggguaccucaacugguaccagcagcgccggggccgcgcgcccaagcugcugauguacgacgggagccggcucgugaccggcgugcccucccgcuucagcgggcggcgcuggggcacccaguacaaccugacgaucggcucccugcagcccgaggacgucgccaccuacuacugccagguguacgaguucuucgggcccggcacccggcucgaccugaagcgcaccguggccgccccgagcgucuucaucuucccgcccuccgac

SEQ ID NO: 11739 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccagaccaccaagggguaccucaacugguaccagcagcgccggggccgcgcccccaagcugcugauguucgacggguccaagcucgugaccggcgugcccagccgguucuccgggcgccgguggggcacccaguacaaccugaccaucggcagccugcagcccgaggaccucgcgaccuacuacugccaggucuacgaguucuucgggcccggcacgcgccuggaccugaagcggaccguggccgccccguccguguucaucuucccgcccagcgac

SEQ ID NO: 11740 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccagaccaacaagggguaccucaacugguaccagcagcgccggggccgcgcccccaagcugcugaugugcgacggguccaagcucgugaccggcgugcccagccgguucuccgggcgccgguggggcacccaguacaaccugaccaucggcagccugcagcccgaggacaucgcgaccuacuacugccaggucuacgaguucuucgggcccggcacccgccucgaccugaagcggacgguggccgccccguccguguucaucuucccgcccagcgac

SEQ ID NO: 11741 - RNA, 345 nt, Artificial Sequence
  derived and/or modified sequence opt1 from anti-HIV_Chain
gacauccagaugacccagagccccuccagccuguccgcccgcgugggcgacaaggucaccaucacgugccagaccagcgccggguaccucaacugguaccagcagcggcgcggccgggcgcccaagcugcugauguacgacgggucccgccucgugaccggcgugcccagccgguucuccgggcgccgguggggcacccaguacaaccugacgaucggcagccugcagcccgaggacaucgccaccuacuacugccaggucuacgaguucuucgggcccggcacccgccucgaccugaagcggaccguggccgccccguccguguucaucuucccgcccagcgac

SEQ ID NO: 11742 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccagaccaacaagggguaccucaacugguaccagcagaagcgcggccgggcccccaagcugcugauguacgacggguccaagcucgugaccggcgugcccagccgccuguccgggcggcgcuggggcacccaguacaaccugaccaucggcagccuccagcccgaggacaucgcgaccuacuacugccaggucuacgaguucuucgggcccggcacccggcuggaccugaagcgcacgguggccgccccguccguguucaucuucccgcccagcgac

SEQ ID NO: 11743 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccagaccaacaagggguaccucaacugguaccagcagcgccggggccgcgcccccaagcugcugauguacgacggguccaagcucgugaccggcgugcccagccggcuguccgggcgccgguggggcacccaguacaaccugaccaucggcagccuccagcccgaggacaucgcgaccuacuacugccaggucuacgaguucuucgggcccggcacccgccuggaccugaagcggacgguggccgccccguccguguucaucuucccgcccagcgac

SEQ ID NO: 11744 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccacaccaacaagggguaccucaacugguaccagcagcgccggggccgcgcccccaagcugcugauguucgacggguccaagcucgugaccggcgugcccagccgguucuccgggcgccgguggggcacccaguacaaccugaccaucggcagccugcagcccgaggacaucgcgaccuacuacugccaggucuacgagguguucgggcccggcacccgccucgaccugaagcggacgguggccgccccguccgucuucaucuucccgcccagcgac

SEQ ID NO: 11745 - RNA, 345 nt, Artificial Sequence
  derived and/or modified sequence opt1 from anti-HIV_Chain
gacauccagaugacccagagccccuccagccuguccgccagcgugggcgacaccgucacgaucaacugccagaccaacaagggguaccucaacugguaccagcagcgccggggccgcgcccccaagcugcugauguacgacggguccaagcucgugaccggcgugcccagccgguucuccgggcgccgguggggcacccaguacaaccugacgaucggcagccugcagcccgaggacaucgcgaccuacuacugccaggucuacgaguucuucgggcccggcacccgccucgaccugaagcggaccguggccgccccguccguguucaucuucccgcccagcgac

SEQ ID NO: 11746 - RNA, 345 nt, Artificial Sequence
  derived and/or modified sequence opt1 from anti-HIV_Chain
gacauccagaugacccagagccccuccagccuguccgcccgcgugggcgacaaggucaccaucacguaccagaccagcgccggguaccucaacugguaccagcagcggcgcggccgggcgcccaagcugcugauguacgacgggucccgccucgugaccggcgcccccagccgguucuccgggcgccgguggggcacccaguacaaccugacgaucggcagccugcagcccgaggacaucgccaccuacuacugccagguguacgaguucuucgggcccggcacccgccucgaccugaagcggaccgucgccgccccguccguguucaucuucccgcccagcgac

SEQ ID NO: 11747 - RNA, 345 nt, Artificial Sequence
  derived and/or modified sequence opt1 from anti-HIV_Chain
gacauccagaugacccagagccccuccagccuguccgccagcgugggcgacaccgucacgaucacgugccagaccaacaagggguaccucaacugguaccagcagcgccggggccgcgcccccaagcugcugauguacgacggguccaagcucgugaccggcgugcccagccgguucuccgggcgccgguggggcacccaguacaaccugaccaucggcagccugcagcccgaggacaucgcgaccuacuacugccaggucuacgaguucuucgggcccggcacccgccucgaccugaagcggacgguggccgccccguccguguucaucuucccgcccagcgac

SEQ ID NO: 11748 - RNA, 345 nt, Artificial Sequence
  derived and/or modified sequence opt1 from anti-HIV_Chain
gugacccugagccucucccccggcgagcgcgccacccugagcugccgggccucccagacgaucagcaacaacuaccuggcgugguaccagcagaagcccgggcaggcgccccgccuccugaucuacggcgccuccagcggggccaccggccugcccgaccgguucuccgggagcggcuccggcaccgacuucacccucacgaucagccgccuggagcccgaggacuucgccgucuacuacugccaccaguacgcccuguccccguggaccuucgggcggggcaccaagguggagaucaagcgcaccguggccgcccccagcgucuucaucuucccgcccuccgac

SEQ ID NO: 11749 - RNA, 345 nt, Artificial Sequence
  derived and/or modified sequence opt1 from anti-HIV_Chain
acccugagcgccuccgugggcgaccgcgucaccaucacgugccgggccagccaguccaucaacaacuaccucaacugguaccagcagaagcccgggaaggcgcccaagcugcugaucuacgccgccagcucccuccagagcggcgugcccucccgcuucagcggguccggcagcgggaccgacuucacccugaccaucuccagccugcagcccgaggacuucgugacguacuacugccagcagaccuacuccaacccccggauguucggccagggcaccaaggucgagaucaagcgcaccguggccgccccgagcguguucaucuucccgcccuccgacgagcag

SEQ ID NO: 11750 - RNA, 345 nt, Artificial Sequence
  derived and/or modified sequence opt1 from anti-HIV_Chain
cagagcgcccugacccaggcccccuccgcgagcggcaccccggggcagcgcgugacgaucuccugcagcggcgggggcuccaacaucgggggcaaccucgucagcugguaccagcacuuccccggcgccgcccccaagcugcugaucuaccggaacgaccagcgccccuccggggugccggaccgguucagcgccuccaagagcggcaccuccgccagccucgcgaucuccgggcugcgcagcgacgacgaggccaccuacuucugcgccgccuacgacuccacccugagccuccggcuguucggcgggggcacgacccuggcggugcucucccagcccaaggcc

SEQ ID NO: 11751 - RNA, 345 nt, Artificial Sequence
  derived and/or modified sequence opt1 from anti-HIV_Chain
aagcccagccagacccugucccugaccugcacggugagcggcggguccaucagcuccgccggcuacuacuggaccuggauccgccaccacccggggaagggccucgaguucaucggguacaucuaccacaucggcacccccuacuacaaccccagccugaagucccggcucaccaucagcaucgacacguccaagaaccaguucagccugaagcuguccagcgucaccgccgcggacaccgccaucuacuacugcgcccgcgacuacaccgcccggggccgccacuucuucgacuacugggggcagggcgcccucgugacgguguccagcgcguccaccaagggg

SEQ ID NO: 11752 - RNA, 345 nt, Artificial Sequence
  derived and/or modified sequence opt1 from anti-HIV_Chain
cccagcgagacccugucccugaccugccgcgugagcggcgccuccaucagcaacuucuacuggacguggauccggcagcccgccgggaagggccucgaguggaucgggcgccuguacuccagcgacaagaccaacuacaaccccucccucaacggccgggucaccaugagccuggacaccuccaagaaccaguucagccugcgccucacguccaugaccgacgcggacaccgccaucuacuacugcgcccgggagaaggggcagugggugacccugccgcccuacuacuucgacagcuggggccagggcauccuggugacggucuccagcgccuccaccaagggg

SEQ ID NO: 11753 - RNA, 348 nt, Artificial Sequence
  derived and/or modified sequence opt1 from anti-HIV_Chain
ggccccgccacccugagcgugucccccggggagcgcgccacccucagcugccgggcgucccagagccugcgcaacaaccuggccugguaccagcagaagacgggccagagcccccggcuccugaucuacgccgucuccacccgcgccaccgggaucccgccccgguucuccggcgggggcagcggcaccgaguucacgcugaccaucgacucccuccagagcgaggacuucgccguguacuucugccagcaguacgacagcccccaguggaccuucgggcagggcaccaagguggagaucaagcgcacggucgcggcccccuccguguucaucuucccgcccuccgac

SEQ ID NO: 11754 - RNA, 348 nt, Artificial Sequence
  derived and/or modified sequence opt1 from anti-HIV_Chain
gcccccgugacccugagcgccuccgucggcgacaccgugacgaucacgugccgcgcgagccagccgaucgccaccuuccucaacugguaccagcacaagcccgggcaggcccccaagcugcugaucuacgccgccuccaccuuccagcggggcgcgcccagccgcuacuccgggagcggcuccgggaccgacuucacccucaccaucaacagccugcagccggaggaccuggccaccuacuacugccagcagacguucaccgaccccgugaccuucggccagggcacccggcucgagaucaagcgcacggucgccgcccccuccguguucaucuucccgcccagcgac

SEQ ID NO: 11755 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggggcuggcucgcgugguaccaccagcgcccggggaaggcgccccggcugcugaucuaccgcggcucccggcuccucgggggcguccccagccgcuucuccggcagcgccgccgggaccgacuucacccugacgaucgccaaccugcaggccgaggacuucggcaccuucuacugccagcaguacgacaccuaccccgggaccuucggccaggggacgaagguggaggugaagcggaccgucgccgccccguccguguuc

SEQ ID NO: 11756 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggaacugggucgcgugguaccagcagcgcccgggcaaggcgccccggcuccugaucuaccgcggggccgcccugcucggcggggugcccucccgguucagcggcuccgccgccggcaccgacuucacccugacgaucgggaaccugcagaccgaggacuucggcaccuucuacugccagcaguacgacaccuaccccgggacguucggccaggggaccaagguggaggucaagcgcaccguggccgccccgagcguguuc

SEQ ID NO: 11757 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggaacugggucgcgugguaccagcagcgcccgggcaaggcgccccggcuccugaucuaccgcggggccgcccugcucggcggggugcccucccgguuccgcggcagcgccgccggcaccgacuucacccugacgaucgggaaccugcaggccgaggacuucggcaccuucuacugccagcaguacgacaccuaccccgggaccuucggccaggggacgaagguggaggucaagcggaccguggccgccccguccguguuc

SEQ ID NO: 11758 - RNA, 351 nt, Artificial Sequence
  derived and/or modified sequence opt1 from anti-HIV_LightChain
gacauccagaugacccagagccccuccacccugagcgccuccgugggcgacacgguccgcaucagcugccgggccucccagagcaucaccgggggcuggcucgcgugguaccaccagcgcccggggaaggcgccccggcugcugaucuaccgcggcucccggcuccucgggggcgugcccagccgcuucuccggcagcgccgccgggaccgacuucacccugacgaucgccaaccugcaggccgaggacuucggcaccuucuacugccagcaguacgacaccuaccccgggaccuucggccaggggacgaagguggaggucaagcggaccguggccgccccguccguguuc

SEQ ID NO: 11759 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggaacugggucgcgugguaccagcagcgcccgggcaaggcgccccggcuccugaucuaccgcggggccgcccugcucggcggggugcccucccgguucagcggcuccgccgccggcaccgacuucacccugacgaucgggaaccugcaggccgaggacuucggcaccuucuacugccagcaguacgacaccuaccccgggaccuucggccaggggacgaagguggaggucaagcgcaccguggccgccccgagcguguuc

SEQ ID NO: 11760 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggggcugggucgcgugguaccaccagcgcccggggaaggcgccccggcuccugaucuaccgcggcucccggcugcucgggggcgugcccagccgcuucuccggcagcgccgccgggaccgacuucacccugacgaucggcaaccugcaggccgaggacuucgggaccuucuacugccagcaguacgacaccuaccccggcaccuucgggcagggcacgaagguggaggucaagcggaccguggccgccccguccguguuc

SEQ ID NO: 11761 - RNA, 351 nt, Artificial Sequence
  derived and/or modified sequence opt1 from anti-HIV_LightChain
gacauccagaugacccagagccccuccacccugagcgccuccgugggcgacacgguccgcaucagcugccgggccucccagagcaucaccgggggcuggcucgcgugguaccaccagcgcccggggaaggcgccccggcugcugaucuaccgcggcucccggcuccucgggggcgugcccagccgcuucuccggcagcgccgccgggaccggcuucacccugacgaucgccaaccugcaggccgaggacuucgggaccuucuacugccagcaguacgacaccuaccccggcaccuucgggcagggcacgaagguggaggucaagcggaccguggccgccccguccguguuc

SEQ ID NO: 11762 - RNA, 351 nt, Artificial Sequence
  derived and/or modified sequence opt1 from anti-HIV_LightChain
gacauccagaugacccagagccccuccacccugagcgccuccgugggcgggacgguccgcaucagcugccgggccucccagagcaucaccggcggguggcucgcgugguaccaccagcgcccgggcaaggcgccccggcugcugaucuaccgcgggucccggcuccugggcggcgugcccagccgcuucuccgggagcgccgccggcaccgacuucacccugacgaucgccaaccuccaggccgaggacuucgggaccuucuacugccagcaguacgacaccuaccccggcaccuucgggcagggcacgaagguggaggucaagcggaccguggccgccccguccguguuc

SEQ ID NO: 11763 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggaacugggucgcgugguaccaccagcgcccgggcaaggcgccccggcuccugaucuaccgcggggccgcccugcucggcggggugcccucccgguucagcggcuccgccgccggcaccgacuucacccugacgaucgggaaccugcaggccgaggacuucggcaccuucuacugccagcaguacgacaccuaccccgggaccuucggccaggggacgaagguggaggucaagcgcaccguggccgccccgagcguguuc

SEQ ID NO: 11764 - RNA, 351 nt, Artificial Sequence
  derived and/or modified sequence opt1 from anti-HIV_LightChain
gacauccagaugacccagagccccuccacccugagcgccuccaucggcgacacggugaugaucagcugccgcgccucccagagcaucaccgggggcuggcucgcgugguaccaccagcggccggggaaggcgccccgccugcugaucuaccggggcuccaagcuccucgggggcguccccagccgcuucuccggcagcgccgccgggaccggcuucacccugacgaucgggaaccugcaggccgaggacuucggcaccuucuacugccagcaguacgacaccuaccccgggaccuucggccagggcacgaagguggaggugaagcggaccgucgccgccccguccguguuc

SEQ ID NO: 11765 - RNA, 351 nt, Artificial Sequence
  derived and/or modified sequence opt1 from anti-HIV_LightChain
gacauccagaugacccagagccccuccacccugagcgccuccgugggcgacacgguccgcaucagcugccgggccucccagagcaucaccgggggcuggcucgcgugguaccaccagcgcccggggaaggcgccccggcugcugaucuaccgcggcucccggcuccucgggggcgugcccagccgcuucuccggcagcgccgccggggccgacuucacccugaccaucgccaaccugcaggccgaggacuucggcacguucuacugccagcaguacgacaccuaccccgggaccuucggccaggggaccaagguggaggucaagcggacgguggccgccccguccguguuc

SEQ ID NO: 11766 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggggcuggcucgcgugguaccaccagcgcccggggaaggcgccccggcugcugaucuaccgcggcucccggcucgucgggggcgugcccagccgcuucuccggcagcgccgccgggaccgacuucacccugacgaucggcaaccugcaggccgaggacuucgggaccuucuacugccagcaguacgacaccuaccccggcaccuucgggcagggcacgaagguggaggucaagcggaccguggccgccccguccguguuc

SEQ ID NO: 11767 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggggcuggcucgcgugguaccaccagcgcccggggaaggcgccccggcugcugaucuaccgcggcucccggcuccucgggggcguccccagcaaguucuccggcagcgccgccgggaccgacuucacccugacgaucgccaaccugcaggccgaggacuucggcaccuucuacugccagcaguacgacaccuaccccgggaccuucggccaggggacgaagguggaggugaagcgcaccgucgccgccccguccguguuc

SEQ ID NO: 11768 - RNA, 351 nt, Artificial Sequence
  derived and/or modified sequence opt1 from anti-HIV_LightChain
gacauccagaugacccagagccccuccacccugagcgccuccacgggcgacaccgugcgcaucagcugccgggccucccagagcaucaccgggaacugggucgcgugguaccagcagcgcccgggcaaggcgccccggcuccugaucuaccgcggggccgcccugcucggcggggugcccucccgguuccgcggcagcgccgccggcaccgacuucacgcugaccaucgggaaccugcaggccgaggacuucggcaccuucuacugccagcaguacgacaccuaccccgggacguucggccaggggaccaagguggaggucaagcggaccguggccgccccguccguguuc

SEQ ID NO: 11769 - RNA, 351 nt, Artificial Sequence
  derived and/or modified sequence opt1 from anti-HIV_LightChain
gacauccagaugacccagagccccuccacccugagcgccuccaucggcgacacggugcgcaucagcugccgggccucccagagcaucaccgggaacuggcucgcgugguaccaccagcgcccgggcaaggcgccccggcugcugaucuaccgcgggucccggcuccugggcgggguccccagccgcuucuccggcagcgccgccggcaccgacuucacccugacgaucgccaaccuccaggccgaggacuucgggaccuucuacugccagcaguacgacaccuaccccggcaccuucgggcagggcacgaagguggaggugaagcggaccgucgccgccccguccguguuc

SEQ ID NO: 11770 - RNA, 351 nt, Artificial Sequence
  derived and/or modified sequence opt1 from anti-HIV_Chain
aucauccuguuccucguggccaccgccaccggcagcugggcgcaguccgcccugacgcagccccgcagcgucuccgggagccugggccaguccgugaccaucagcugcaccggguccagcuccgacgugggccgguacaacuacgucagcugguaccagcaccacccggggaaggcccccaagcucaugaucuccgacgugaacaagcgccccagcggcgugcccgaccgguucuccggcagcaaguccgggaacaccgccagccugacgaucuccggccugcaggccgaggacgagaccgacuacuacugcugcagcuacgcgggguccuacaucugggucuucggcggg

SEQ ID NO: 11771 - RNA, 351 nt, Artificial Sequence
  derived and/or modified sequence opt1 from anti-HIV_Chain
cccgugacccugagcgccuccgucggcgaccgcgugaccaucacgugccgggccagcgaggacaucuccaaguaccucaacugguaccagcacaagcccgggaaggcgcccaagcugcugaucuacaccgccagcucccucgagaccggcgugcccagccgcuucuccgggagcggcuccgggaccgacuucagccugacgaucuccagccugcagcccgacgacuucgccaccuacuacugccagcaguccuacaccagcuccgucaccuucggccagggcacgcggguggaggugaagcgcaccgucgccgccccgagcguguucaucuucccgcccuccgacgagcag

SEQ ID NO: 11772 - RNA, 351 nt, Artificial Sequence
  derived and/or modified sequence opt1 from anti-HIV_Chain
guggaggagcccggcagcuccgucaaggugagcugcaaggccuccgggggcagcuccaccgccuacggguacagcugggugcgccaggcgccgggccagggguucgaguggaugggccggaucauccccuucuacggcaucaucaccuacgcccccaaguuccaggggcgcgucacgaucaccgccgaccgguccaccagcaccguguacauggagcugacgcgccucaccuucgccgacaccgcccuguucuucugcgcgcgggacuacggcgacccccgcaacggguacuacuucgacuccugggaccagggccuguggcucaccgugagcuccgccagcacgaagggg

SEQ ID NO: 11773 - RNA, 351 nt, Artificial Sequence
  derived and/or modified sequence opt1 from anti-HIV_Chain
caggugcgccuggagcagagcggcgccgccguccggacccccggggcguccgugacccucagcugccaggccuccggcuacaaguucgugaacuacaucauccacuggguccgccagcggccggggcuggccuucgagugggugggcaugaucgaccccuaccgcgggcggcccuggagcgcccacuccuucgagggccgccugagccucucccgggacgugagcauggagauccuguacaugacgcugaccucccuccgcagcgacgacaccgccaccuacuucugcgcgcgggccgaggccgagucccagagccacucccgccccaucaucagcacguccggcgcccgg

SEQ ID NO: 11774 - RNA, 351 nt, Artificial Sequence
  derived and/or modified sequence opt1 from anti-HIV_Chain
gugcaccuggagguccagcuccagcagagcggccccgagcugaagaagccgggggagaccgugaagaucuccugcaaggccagcguguacaccuucacggaguaccccauccacugggucaagcaggcccccggcaagggguucaaguggaugggcuggaucaacaccuacuccggggagcccaccuacgcggacgacuucaagggccgcuucgccuucagccuggagaccuccgccagcacggccuaccuccagaucaacucccugaagaacgaggacaccgccaccuacuucugcgcgagccugggccgggacuacugggggcagggccaggggaccacgcucaccgug

SEQ ID NO: 11775 - RNA, 354 nt, Artificial Sequence
  derived and/or modified sequence opt1 from anti-HIV_Chain
cugagcgugucccucggcgagcgcgccaccaucaacugcaagagcucccagagcauccuguacuccagcgacaagaagaacuaccuggccugguaccagcagaagaucgggcagcccccgaagcuccugcuguacugggcguccacccgggagagcggcauccccgaccgcuucuccgggagcggcuccgggagcgacuucacgcucaccaucuccagccugcagcccgaggacgucgccguguacuacugccagcaguacuacaucucccccuucaccuucggccccggcaccaagguggaccugaagcggacggucgccgcccccagcguguucaucuucccgcccuccgac

SEQ ID NO: 11776 - RNA, 354 nt, Artificial Sequence
  derived and/or modified sequence opt1 from anti-HIV_Chain
cagagcgugcugacccagcccccguccgccagcggcgcccccgggcagcgcgucaccaucuccugcagcggcgggcccuccaacgugggcgggaacuacguguacugguaccggcaguuccccggcacggcgccgaagcuccugauccugcgcgacgaccagcggcccagcggcguccccgaccgcuucuccgccagcaaguccgggaacagcgccucccucgccaucagcggccugcggcccgacgacgaggccuucuacuucugcgcgaccuacgacuccgacgggagcauccgccuguucggcgggggcaccgcccucaccgugcugucccagccgaaggccgcccccagc

SEQ ID NO: 11777 - RNA, 354 nt, Artificial Sequence
  derived and/or modified sequence opt1 from anti-HIV_Chain
aaggcccccgccacccugagccucucccccggcgagcgcgcgacccugagcugccgggccucccagagcgugggguccgaccuggccugguaccagcagaagcccggccaggcgccccgccuccugaucuacgacgccagcaaccgggccacggccauccccgcccgcuucuccgggagcggcuccgggaccgacuucacccugagcaucuccagccucgagccggaggacuucgccgucuacuucugccagcagcgguacgacaagaucaccuucggccagggcacgcgccuggagauccagcggaccguggcggcccccuccguguucaucuucccgcccagcgacgagcag

SEQ ID NO: 11778 - RNA, 354 nt, Artificial Sequence
  derived and/or modified sequence opt1 from anti-HIV_Chain
caggugcagcugguccagagcggcgccgaggccaagcgccccggggacuccgugaaggugagcugcaaggcguccggcuacaccuucaccgaguacuacauccacuggguccggcagacgccggggcagggcuucgaguggauggggaucaucacccccggcgccggcaacaccaccuacgcccagaaguuccaggggcgcaucacggugacccgggacaccagcgccgccaccguguacauggagcucuccaaccugacgagcgaggacaccgcggucuacuucugcucccgcggcgugagcuucugggggcagggcacccuggugaccgucuccagcgccuccacgaagggg

SEQ ID NO: 11779 - RNA, 354 nt, Artificial Sequence
  derived and/or modified sequence opt1 from anti-HIV_HeavyChain
gaggugaagcugcagcagagcggcgccgagcucguccgccccggggccuccgugaagaugagcugcaaggcguccggcuaccgguucaccagcuacaacaugcacugggugaagcagaccccgcgccaggggcuggaguggaucggcgccaucuaccccgggaacggcgacacguccuacaaccagaaguucaagggcaaggccacccugaccgucgacaagagcuccagcaccgccuacaugcagcucuccagccugacguccgaggacagcgccguguacuucugcgcgcgggggcgccugucccucggcuucgacuacugggggcagggcagcacccugaccguguccagc

SEQ ID NO: 11780 - RNA, 357 nt, Artificial Sequence
  derived and/or modified sequence opt1 from anti-HIV_Chain
caggugcagcugguccagagcggcaccgccgugaagcgccccggggccuccgugcgggucagcugccaggcguccggcuacaccuucaucgaccacuucaucuacugguggcgccaggccccggggcagggccucgaguggcugggguggaucaacccccugacgagccagcccuccuaccccagccgguuccagggccgccucacccugacccgggacaccuucgacgagaugcuguacauggaccuccgcggccugcgguccgacgacacggggaucuacuucugcgcccgccggcacagcgacuacugcgacuucgacaucuggggcuccgggacccagaucaucgugagcucc

SEQ ID NO: 11781 - RNA, 357 nt, Artificial Sequence
  derived and/or modified sequence opt1 from anti-HIV_Chain
caggugcagcugguccagagcggcaccgccgugaagcgccccggggccuccgugcgggucagcugccaggcguccggcuacaccuucacggacuacuucaucuacugguggcgccaggccccggggcagggccucgaguggcugggguggaucaacccccugaccagccagcccuccuaccccagccgguuccagggccgccucacccugacccgggacacguucgacgagaugcuguacauggaccuccgcggccugcgguccgacgacaccgggaucuacuucugcgcccgccggcacagcgacuacugcgacuucgacaucuggggcuccgggacccagaucaucgugagcucc

SEQ ID NO: 11782 - RNA, 357 nt, Artificial Sequence
  derived and/or modified sequence opt1 from anti-HIV_Chain
cagagcgugcugacccagccccgcuccgucagcggcuccccggggcagagcgugaccaucuccugcacgggcaccagcuccgacgucgggggcuacaacuacgugagcugguaccagcagcaccccgggaaggcccccaagaccaugaucuucgacgugaccaagcggcccuccggcgugccggaccgcuucagcggcuccaagagcgggaacacggccucccucaccaucagcggccugcaggcggaggacgaggccgacuacuacugcuccagcuacgccgggcggaacaccuucuacgucuucggcaccgggacgaccgugaccgugcaggucucccccagccagcccccgccc

SEQ ID NO: 11783 - RNA, 357 nt, Artificial Sequence
  derived and/or modified sequence opt1 from anti-HIV_Chain
gagaucgugcugacccagagccccggcacccucucccugagcccgggggagcgcgccacgcuguccugccgggccagccaguccgucagcuccaacuaccucgcgugguaccagcagaagcccggccaggcgccccgccugcugaucuacggggccagcucccgggccaccggcauccccgaccgcuucagcggguccggcagcggcaccgacuucacccucuccaucagccggcuggagccggaggacuucgccguguacuacugccagcaguacgggacguccagcugcaccuucggccaggggaccaagcuggagaucaagcgcaccguggccgcccccuccgucuucaucuuc

SEQ ID NO: 11784 - RNA, 357 nt, Artificial Sequence
  derived and/or modified sequence opt1 from anti-HIV_Chain
cugagcgccuccgugggcgaccgcgucaccaucacgugccgggccagccaguccaucgaccgcuaccucaacugguaccagcagaagcccgggaaggcgcccaagcugcugaucuacgccgccagcucccuccacaccgacgugcccagccgguucuccggcagcggggccggcaccuacuucacccugaccaucacgucccugcagcccgaggacuucgccaccuacuacugccagcagagccacucccccagcuucgggcaggaguccuacagcaucaccuucggccagggcacccgccucgagaucaagcggacgguggcggccccguccgucuucaucuucccgcccagcgac

SEQ ID NO: 11785 - RNA, 357 nt, Artificial Sequence
  derived and/or modified sequence opt1 from anti-HIV_Chain
aacuucaugcugacccaggcccccagcgccuccggcgcgccggggcagcgcgugaccaucagcugcuccggcgggcccagcaacgucggcgggaacuacguguacugguaccggcaguaccccggcacggcccccaagcuccugauccugcgcgacgaccagcggccguccggcgugcccgaccgcuucagcgccuccaagagcgggaacuccgccagccucgccaucuccgagcugcggcccgacgacgaggcguucuacuucugcgccaccuacgacagcgacggcuccauccgccuguucgggggcgggaccgcccucaccguccugagccagcccaaggccgcgccguccgug

SEQ ID NO: 11786 - RNA, 360 nt, Artificial Sequence
  derived and/or modified sequence opt1 from anti-HIV_Chain
gacauccagaugacccagagccccuccagccuguccgccagcaucggcgaccgcgugaacaucacgugccaggccucccgggacaccgggagcgcgcucaacugguaccagcagaaggucggccgcccgccccggcugcugaucuccgccgugagcaaccucggggccggcgugcccucccgcuucagcgggcggcgcuccggcacccagagcacccugaccaucaacacgcugcagcccgaggacaucgccaccuacuucugccagcacuacgaguucuucggccccgggaccaaggucgacaucaagcggaccguggccgcgcccuccguguucaucuucccgcccagcgacgagcag

SEQ ID NO: 11787 - RNA, 360 nt, Artificial Sequence
  derived and/or modified sequence opt1 from anti-HIV_Chain
cagagcgugcugacccagcccgccuccgucagcggcuccccggggcagagcaucaccaucuccugcacgggcaccagcaacgacgucgggggccagaacuucguguccugguaccagcagcaccccgggaccgcgccccagcuccugaucuacgacgugaccaaccgccccgccggcgugagcucccgguucagcggcuccaagagcgggaacacggccucccugaccaucagcggccuccgcaccgaggacgaggccgacuacuacugcgccuccuucaccauccugaacgggguggacuacgucuucggcacggggaccaaggugaccgugcugcucagcccgucccagcccuaccug

SEQ ID NO: 11788 - RNA, 360 nt, Artificial Sequence
  derived and/or modified sequence opt1 from anti-HIV_Chain
aacuucaugcugacccagcccgccagcguguccggcagcccggggcaguccaucacccucagcugcacgggcaccaccuccgacguccgcgacagcaacuucguguccugguaccagcagguccccgggaaggcccccaagcugaucaucuacgacgugagcgcgcggcccuccggcgugagcuuccgcuucuccgggagcaaguccggcaacaccgccagccugacgaucuccggccuccaggccgaggacgaggcccuguacuacugcagcuccuucaccccgaccaacacccugguguucgggggcgggacgaagcucaccguccugggccagcccaaggccgcgcccagcgugacc

SEQ ID NO: 11789 - RNA, 360 nt, Artificial Sequence
  derived and/or modified sequence opt1 from anti-HIV_Chain
cagagcgcccugacccagcccccggccgcguccggcgcccccgggcagcgcgugaccaucagcugcuccggcgggggcagcaacgucgggggcaaccucguguccugguaccagcaguuccccggcgccgcccccaagcugauccugcaccgggacgggcagcgcccgagcggcgugcccgaccgguucuccgccagcaaguccgggacgagcgcgucccucaccaucagcggccugcgcuccgacgacgaggccaccuacuucugcgccgccuacgacagcgcggucucccugcccguguucgggggcggcaccaagcucacggugcugagccagcccaaggccgccccgcuggucacc

SEQ ID NO: 11790 - RNA, 360 nt, Artificial Sequence
  derived and/or modified sequence opt1 from anti-HIV_Chain
cagcuggugcucacccagcccccgagcgucuccggcacccccgggcagaacgugacgaucagcugcuccggcgggggcagccacgucgggggcaaccugguguccugguaccagcacuuccccggcgccgcccccaagcugcucauccaccgcgacaaccagcggccgagcggggugcccgaccgcuucuccgcgcucaagagcggcaacuccgccagccuggccaucuccgggcugcggagcgacgacgaggccuucuacuucugcgccguguacgacuccagccugucccugggccucuucgggggcggcaccaagcugaccguccugagccagcccaaggcggcccccuccgugacc

SEQ ID NO: 11791 - RNA, 360 nt, Artificial Sequence
  derived and/or modified sequence opt1 from anti-HIV_Chain
gacauccagaugacccagagccccuccagccuguccgccagcgugggcgaccgcgucuccauccacugccaggccgggcagggcaucgggagcucccucaagugguaccagcagaaguccggccgggcgccccgccugcuggugcacggggccagcaaccuccagcggggcgugcccagccgcuucuccggcagcggguuccacaccacguucacccugaccaucuccagccugcagcccgacgacgucgccaccuacuggugcgccgugcucgaguucuucggccccgggacgaagguggagaucaagcggaccgucgccgcgccguccguguucaucuucccgcccagcgacgagcag

SEQ ID NO: 11792 - RNA, 360 nt, Artificial Sequence
  derived and/or modified sequence opt1 from anti-HIV_Chain
gacauccagaugacccagagccccuccagccuguccgccagcgugggcgaccgcgucaccaucacgugccaggccucccaggggaucggcagcucccuccagugguaccagcagaagcccgggcgggcgcccaagcugcuggugcacggcgccagcaaccuccaccgcggggugcccucccgguucagcggcuccggcuuccacaccagcuucacccugaccaucuccagccugcagcccgacgacgucgccacguacuucugcgccgugcucgaguucuucgggccgggcaccaagguggagaucaagcgcaccgucgccgcgcccuccguguucaucuucccgcccagcgacgagcag

SEQ ID NO: 11793 - RNA, 360 nt, Artificial Sequence
  derived and/or modified sequence opt1 from anti-HIV_Chain
gacauccagaugacccagagccccuccagccuguccgccagcgugggcgaccgcgucuccaucaacugccaggccgggcagggcaucgggagcucccucaacugguaccagcagaagcggggcaaggcgcccaagcugcuggugcacggggccagcacccuccagcgcggcgugcccucccgguucagcggcuccggguuccacacgaccuucacccugaccaucagcucccugcagcccgacgacgucgccacguacuucugcgagagcuuccagugguucggccccgggaccaagguggagaucaagcgcaccguggccgccccguccgucuucaucuucccgcccagcgacgagcag

SEQ ID NO: 11794 - RNA, 360 nt, Artificial Sequence
  derived and/or modified sequence opt1 from anti-HIV_Chain
uacauccagaugacccagagccccuccagccuguccgccagcaucggcgaccgcgugaccaucacgugccaggccgggcagggcaucggguccagccucaacugguaccagcagaagcccggcaaggcgcccaagcugcugguccacggggccuccaaccuccagcggggcgugagcucccgcuucagcggcuccggguuccacaccaccuucacccugacgaucagcucccugcggcccgaggacgugggcaccuacuucugcgaggucuacgaguucaucgggcccggcaccaagguggacaucaagcgcaccguggccgccccgagcgucuucaucuucccgcccuccgacgagcag

SEQ ID NO: 11795 - RNA, 360 nt, Artificial Sequence
  derived and/or modified sequence opt1 from anti-HIV_Chain
gacauccagaugacccagagccccuccagccugccggccuccgugggcgacaccgucacgaucacgugccaggccgggcagggcaucgggagcucccuccagugguaccagcagcgccccggccgggcgcccaaccugcugguguacgacgccagcaaccuccagcgcggggugcccucccgguucaccggcaccggcuuccacaccaccuucacccugaccauccgcgggcugcggccggaggacuucggcacguacuucugcgccagccucgaguucuucgggcccggcaccaaggucgacaucaagcgcaccguggccgcccccuccguguucaucuucccgcccagcgacgagcag

SEQ ID NO: 11796 - RNA, 360 nt, Artificial Sequence
  derived and/or modified sequence opt1 from anti-HIV_Chain
gacauccagaugacccagagccccuccagccuguccgccagcgugggcgaccgcgucaccaucacgugccaggccucccaggggaucggcagcucccuccagugguaccagcagaagcccgggcgggcgcccaaccugcuggugcacggcgccagcaaccuccaccgcggggugcccucccgguucagcggcuccggcuuccacaccaccuucagccugaccaucuccgggcugcagcgcgacgacuucgccacguacuucugcgccguccucgaguucuucggccccgggaccaagguggacaucaagcggaccguggccgcgccgagcgucuucaucuucccgcccuccgacgagcag

SEQ ID NO: 11797 - RNA, 360 nt, Artificial Sequence
  derived and/or modified sequence opt1 from anti-HIV_Chain
gacauccagaugacccagagccccuccagccuguccgugagcgucggcgaccgcguguccaucacgugccgggccacccaggggaucggcaacagccucaacugguaccagcagaagcccgggaaggcccccaaggugcugaucuacggcaccaccaagcugcacgggggcguccccucccgcuucagcggcgggggcuccgggagcaccggcacgcucaccaucgacucccugcagcccgaggacaucgcgaccuacuucugccagcuguucgaguucuucgggccgggcaccaagguggagaucaagcggacgguggccgcccccagcgucuucaucuucccgcccuccgacgagcag

SEQ ID NO: 11798 - RNA, 360 nt, Artificial Sequence
  derived and/or modified sequence opt1 from anti-HIV_Chain
gacauccagaugacccagagccccuccagccuguccgccagcgugggcgaccgcgucaccaucacgugccaggccgggcagggcaucggguccagccucaacugguaccagcagaagcccggccgggcgcccaagcugcugguguacggggccuccaaccuccagcgcggcgugcccagccgguucuccggcagcggguuccacaccaccuucacccugacgaucuccagccugcagcccgaggacuucgccaccuacuucugcuccgucuacgaguuccucggcccggggaccaagguggagaucaagcgcaccguggccgcccccagcgucuucaucuucccgcccuccgacgagcag

SEQ ID NO: 11799 - RNA, 360 nt, Artificial Sequence
  derived and/or modified sequence opt1 from anti-HIV_Chain
cccauguuccagccgggccagagcgggggcguggucgugcaguccggggagagccugcaccucuccugcgaggccagcggcuucaaguucgccucccagaugaugcacugggugcgccacguccccgggcggggccuggaguggguggcgcugaucagcugggacggcuccgggaagcuguucgccgacagcgugcgcggccgguucaccauccaccgcuggaacgaccggaacucccucuaccuggacgucaagaacgugcgccccgaggacgccgccaucuacuacugcacccggaacggguucgacguguggggccaggggauccucgucacggugagcuccgccagcaccaagggc

SEQ ID NO: 11800 - RNA, 363 nt, Artificial Sequence
  derived and/or modified sequence opt1 from anti-HIV_HeavyChain
gaggugaagcuggucgagagcggcgggggccucgugcagcccgggggcucccugcgccugagcugcgccgccuccggguucaccuucagcuccuucggcaugcacugggugcggcaggcgccggagaagggccucgagugggucgccuacaucagcuccgggagcuccacccugcacuacgccgacacggugaagggccgcuucaccaucagccgggacaacuccaagaacagccuguaccuccagaugaaccugcugcgcgccgaggacaccgccguguacuacugcgcgcgggggucccgcaaccucagccaccggcugcuguccuacuggggccaggggacccucgucacggugagcucc

SEQ ID NO: 11801 - RNA, 363 nt, Artificial Sequence
  derived and/or modified sequence opt1 from anti-HIV_HeavyChain
gaggugcagcuggucgagagcggcgggggccucgugcagcccgggggcucccugcgccugagcugcgccgccuccggguucaccuucagcuccuucggcaugcacugggugcggcaggcgccgggcaaggggcucgagugggucagcuacaucuccagcggcuccagcacccugcacuacgccgacacggugaaggggcgcuucaccaucucccgggacaacagcaagaacucccuguaccuccagaugaacagccugcgcgccgaggacaccgccguguacuacugcgcccggggcucccgcaaccugagccaccggcuccuguccuacugggggcagggcacccuggucacggugagcucc

SEQ ID NO: 11802 - RNA, 363 nt, Artificial Sequence
  derived and/or modified sequence opt1 from anti-HIV_Chain
gacauccagaugacccagagccccuccagccuguccgccagcgugggcgaccgcgucaccaucacgugccaggccucccaggggaucagcaacucccucaacugguaccagcagaagcccggcaaggcgccccggcugcugaucuacgggaccagcacccuccagcgcggcgugcccucccgguucagcggguccggcagcggcacccgcuucacggugaccaucaacucccugcagcccgaggacaucgccaccuacuucugccagcacaacgaguucuucgggcggggcaccaaggucgacaucaagcgcacgguggccgccccgagcguguucaucuucccgcccuccgacgagcagcug

SEQ ID NO: 11803 - RNA, 363 nt, Artificial Sequence
  derived and/or modified sequence opt1 from anti-HIV_Chain
gacauccagaugacccagagccccuccagcguguccgccagcgucggcgaccgcgugaccaucacgugccaggccucccgggacaccgacaacagccugaccugguaccagcagaagccggggcgcccgcccaagcuccugaucuaccacguggucaaccugggccccggggugcccucccgguucagcggcuccgcgagcuccgccacccagagcacgcucaucaucuccgacuuccagcccgacgacguggccaccuacuucugccagaacuacgaguucuucgggcccggcaccaaggucgagaucaagcgcaccguggccgcccccagcguguucaucuucccgcccuccgacgagcag

SEQ ID NO: 11804 - RNA, 363 nt, Artificial Sequence
  derived and/or modified sequence opt1 from anti-HIV_Chain
gagaucgugcugacccagagccccggcacccucucccugagccccggggagcgcgccacgcuguccugccgggccagccaguccgucagcuccaacaaccucgcgugguaccagcagaagcccggccaggcgccccgccugcugaugagcggggccuccagccgggccaccggcauccccgaccgcuucuccgggagcggcuccggcaccgacuucacccucacgaucagccggcuggagccggaggacuucgccguguaccacugccagcaguacggguccagcccgcccaccuucggccaggggaccaagguggagaucaagcgcaccgucgccgcccccuccguguucaucuucccgccc

SEQ ID NO: 11805 - RNA, 363 nt, Artificial Sequence
  derived and/or modified sequence opt1 from anti-HIV_Chain
gacauccagaugacccagagccccuccagccuguccgccuacgugggcgaccgcgucaccaucacgugccgggccagccagaacaucaacaccuaccucaacugguaccagcagcgcccggggaaggcgcccaagcugcugaucuacgccgccuccacccuccagagcggcgugcccucccgguucagcggguccggcagcgggaccgacuucacgcugaccaucuccaaccuggagaccgaggacuucgccguguacuacugccagcagaccuaccgcagcgucacguucggccagggcaccaagcucgagaucaagcggaccguggccgcgcccuccguguucaucuucccgcccagcgac

SEQ ID NO: 11806 - RNA, 363 nt, Artificial Sequence
  derived and/or modified sequence opt1 from anti-HIV_Chain
gacauccagaugacccagagccccuccagccuguccgccagcgugggcgaccgcgucaccaucacgugccaggccgggcagggcaucggguccagccuccagugguaccagcagaagcccggcaaggcgcccaagcugcuggugcacggggccuccaaccuccaccggggcgugcccagccgcuucuccggcagcggguuccacaccaccuucucccugaccaucagcggccugcagcgggacgacuucgccacguacuucugcgccgucguggaguucuucgggcccggcaccaagguggacaucaagcgcaccgucgccgcgccguccguguucaucuucccgcccagcgacgagcagcuc

SEQ ID NO: 11807 - RNA, 363 nt, Artificial Sequence
  derived and/or modified sequence opt1 from anti-HIV_Chain
caggugcagcuggucgagagcggcgccgagcuccgcaagcccggggagucccuggagaucagcugcaaggccuccggcuacagcuucuccagccacuggaucgggugggcgcggcagaugccgggcaaggggcuggaguggaugggcaucaucuaccccggcgacuccaacaccaucuacagccccuccuuccagggccaggugaccaucagcgccgacaaguccaucaacacggccuaccuccaguggagcucccugaaggccagcgacaccgccauguacuucugcgcguccaacuaccacgacuacuucuacugggggcaggggacccuggugaccgucagcuccgccagcacgaagggc

SEQ ID NO: 11808 - RNA, 363 nt, Artificial Sequence
  derived and/or modified sequence opt1 from anti-HIV_Chain
uucgugcagcuggucgagagcggcgggggcguggugcagcccgggaccucccuccgccugagcugcaccacguccggcuucaucuucagcgacuacgggaugcacuggguccggcaggccgccggcaagggccuggaguggguggcggugaucuggcacgacggguccaaccgcuucuacgccgacagcgucaagggccgguucaccaucucccgcgacaacagcaagaacgccguguaccucgagaugaacaaccugcggguggaggacaccgcccuguacuacugcgcccgcaccuccauggacaucgacuacugggggcagggcacgccggucaccgugagcuccgcgagcaccaagggg

SEQ ID NO: 11809 - RNA, 363 nt, Artificial Sequence
  derived and/or modified sequence opt1 from anti-HIV_Chain
gagcccauguuccagccgggccagagcgggggcguggucgugcaguccggggagagccugcaccucuccugcgaggccagcggcuucaaguucgccucccagaugaugcacugggugcgccacguccccgggcggggccuggaguggguggcgcugaucagcugggacggcuccgggaagcuguucgccgacagcgugcgcggccgguucaccauccaccgcuggaacgaccggaacucccucuaccuggacgucaagaacgugcgccccgaggacgccgccaucuacuacugcacccggaacggguucgacguguggggccaggggauccucgucacggugagcuccgccagcaccaagggc

SEQ ID NO: 11810 - RNA, 366 nt, Artificial Sequence
  derived and/or modified sequence opt1 from anti-HIV_Chain
agccagcaccuggugcaguccggcacccaggucaagaagcccggggccagcgugcgcaucuccugccaggccagcggcuacuccuucaccgacuacgugcuccacugguggcggcaggcgccggggcagggccuggaguggaugggguggaucaagcccgucuacggcgcccgcaacuacgcccggcgcuuccagggccggaucaacuucgaccgcgacaucuaccgggagaucgccuucauggaccugagcgggcuccgcuccgacgacacggcccuguacuucugcgcgcgggacggcagcggggacgacaccuccuggcaccuggaccccuggggccaggggacccucgugaucgugagcgcc

SEQ ID NO: 11811 - RNA, 366 nt, Artificial Sequence
  derived and/or modified sequence opt1 from anti-HIV_Chain
gacauccagaugacccagagccccuccagccuguccgccagcgugggcgaccgcgucaccaucacgugccgggccucccagagcaucucccgcuaccucaacugguaccagcagaagcccgggaaggcgcccaagcugcugaucuacgccgccagcucccuccagggcggggugcccagccgguucuccggcagcggguccggcaccgacuucacccugaccaucagcucccugcagcccgaggacuucgccacguacuacugccagcagagcuccagcaagccguucaccuucggcgggggcaccaagguggagaucaagcgcaccgucgccgcgcccuccguguucaucuucccgcccagcgac

SEQ ID NO: 11812 - RNA, 366 nt, Artificial Sequence
  derived and/or modified sequence opt1 from anti-HIV_Chain
gagaucgugcugacccagagccccggcacccucucccugagccccggggagcgcgccacgcuguccugccgggccagccaguccaucagcuccaacuaccucgcgugguaccagcagaagcccggccaggcgccccgccugcugaucuacggggccagcacccgggccaccggcauccccgaccgcuucuccgggagcggcuccggcaccgacuucacgcucagcaucucccggcuggagccggaggacaucgccgucuacuacugccaccaguacgggagcucccagcgcuucggccaggggaccaagguggagaucaagcggaccguggccgcccccagcgucuucaucuucccgcccuccgac

SEQ ID NO: 11813 - RNA, 366 nt, Artificial Sequence
  derived and/or modified sequence opt1 from anti-HIV_Chain
gagaucgugaugacccagagccccgccacccuguccgucagcccgggcgaccgcgccacgcucuccugccgggcgagccaguccgugagcaccaaccuggccugguaccagcagaagcccgggcaggcgccccgccugcucaucuacggcgccuccacccgggccaccgggauccccgccacguucagcggcuccggguucgccaccgaguucacccugaccaucagcucccugcagagcgaggacuucgccguguacuacugccagcaguacaacaacuggccgcccgccuucggccagggcacgaaggucgagaucaagcgcaccguggcggcccccuccguguucaucuucccgcccagcgac

SEQ ID NO: 11814 - RNA, 366 nt, Artificial Sequence
  derived and/or modified sequence opt1 from anti-HIV_Chain
gacauccagaugacccagagccccgccucccugagcgccuccgugggcgaccgcgucaccaucacgugccgggcgagccaggggaucucccacuaccucgccugguaccagcagaagcccggcaaggugccccgccugcugaucuacgccgccagccggcuccaguccggggugaccagccgcuucuccggcagcggguccggcaccgaguucacccugacgaucagcucccugcuccccgaggacgccgcggucuacuucugccagaaguacgacaccgaccccaugaccuucggccaggggacccggcuggagaucaagcgcacgguggccgccccgagcguguucaucuucccgcccuccgac

SEQ ID NO: 11815 - RNA, 366 nt, Artificial Sequence
  derived and/or modified sequence opt1 from anti-HIV_Chain
cagagcgcccugacccagcccccguccgccagcggcgcgcccgggcagcgcgugaccaucuccugcagcggcgggcccuccaacgucggcgggaacuacguguacugguaccggcaguuccccggcacggccccgaaccuccugauccugcgcgacgaccagcggcccagcggcgugcccgaccgcuucuccgccagcaaguccgggaacagcgccucccucgccaucagcggccugcggcccgacgacgaggcguucuacuucugcgccaccuacgacuccgacgggagcauccgccuguucggcgggggcaccacccucacgguccugucccagccgaaggccgcccccagcgugacccuguuc

SEQ ID NO: 11816 - RNA, 366 nt, Artificial Sequence
  derived and/or modified sequence opt1 from anti-HIV_Chain
gacauccagaugacccagagccccuccagccuguccgccagcgugggcgaccgcgucaccaucaacugccaggccgggcagggcaucggguccagccucaacugguaccagaagaagcccggccgggcgcccaagcugcuggugcacggggccuccaaccuccagcgcggcgugcccagccgguucuccggcagcggguuccacacgaccuucacccugaccaucuccagccugcagcccgacgacgucgccacguacuucugcgccguguuccagugguucggcccggggaccaagguggacaucaagcgcaccgucgccgcgcccuccguguucaucuucccgcccagcgacgagcagcucaag

SEQ ID NO: 11817 - RNA, 366 nt, Artificial Sequence
  derived and/or modified sequence opt1 from anti-HIV_Chain
gacauccagaugacccagagccccuccagccuguccgccagcgugggcgaccgcgucaccaucacgugccaggccucccaggggaucggcagcucccuccagugguaccagcagaagcccgggcgggcgcccaaccugcuggugcacggcgccagcaagcuccaccgcggggugcccucccgguucagcggcuccggcuuccacaccaccuucagccugaccaucuccgggcugcagcgcgacgacuucgccacguacuucugcgccguccucgaguucuucggccccgggaccaagguggagaucaagcggaccguggccgcgccgagcgucuucaucuucccgcccuccgacgagcagcugaag

SEQ ID NO: 11818 - RNA, 366 nt, Artificial Sequence
  derived and/or modified sequence opt1 from anti-HIV_Chain
caggugcaccugguccagagcggcgccgaggugaagaagcccggggccuccgugaaggucagcugcaagguguccggcuacacccucagcgagcuguccauccacugggugcgccaggggccgggccgggggcuggaguggauggcgaacuucgaccccgaggacggcgagaccaucuacgcgccccaguuccagggccgcgucacgcucaccgaggacaccagcaccgacacggccuacaugcagcugaccucccugcggagcgaggacaccgccguguacuacugcgccaccgaccgcuacacggacaccgggcgguggggccccgggacccucgugaccgucuccagcgccuccacgaagggc

SEQ ID NO: 11819 - RNA, 366 nt, Artificial Sequence
  derived and/or modified sequence opt1 from anti-HIV_Chain
caggugcagcuggucgagagcggcgggggccucauccagcccgggggcucccugcgccugagcugcgaggccuccggguucgccgugggcgacaucaacuacaugagcugggugcggcaggcgccgggcaaggggcucgagugggucuccgugcuguacagcggcggguccagccaguacgccgacuccgugaagggccgcuucaccaucagccgggacaacucccgcaacacccuguaccuccagauggacaaccugcgggccgaggacacggccgucuacuacugcgcccgcgggcugcggguguacuucgaccucuggggccagggcauccuggugaccgucagcuccgcgagcaccaagggg

SEQ ID NO: 11820 - RNA, 366 nt, Artificial Sequence
  derived and/or modified sequence opt1 from anti-HIV_Chain
caggugcagauggucgccagcggcgggggccuggugaagcccgggggcucccuccgccugagcugcgaggccuccggguucaccuucagcgacuacuacauguccugggugcggcaggcgccgggcaagggccuggaguggaucagcuacaucaccuccgggggcaacgcccucuacuacgccgacagcgucaaggggcgcuucacgaucucccgggacaacgccaagaacagccuguaccugcagaugaacucccuccgcgccgaggacaccgcgguguacuacugcgcccgggaccugcugcacgcccacgacuucggccgccaggggacccucgugaccgucagcuccgccagcacgaagggc

SEQ ID NO: 11821 - RNA, 366 nt, Artificial Sequence
  derived and/or modified sequence opt1 from anti-HIV_Chain
cagcugcagcucguggagagcggcgggggcgucgugcagcccgggcgcucccugcggcugagcugcgccgccuccggcuucaccuucagcaccuacacgaugcacugggugcgccaggcgccggggaagggccucgagugggucgccgugaucuccuacgacggcaccaacaaguacuacgccgacagcgugaaggggcgguucaccaucucccgcgacaacagcaagaacacccuguaccugcagaugaacucccuccggggcgaggacacggccgucuacuacugcgcccgcagccccuccuacuacuucgacuacugggggcagggcacccuggugaccgugagcgcggccuccaccaagggg

SEQ ID NO: 11822 - RNA, 369 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccgggugagccugacgcgccaggccuccugggacuucgacaccuacagcuucuacauggaccugaaggccgugcgguccgacgacaccgcgaucuacuucugcgcccgccagcggagcgacuucugggacuucgacgucuggggguccggcacccaggugacggugagcucc

SEQ ID NO: 11823 - RNA, 369 nt, Artificial Sequence
  derived and/or modified sequence opt1 from anti-HIV_Chain
caggugcagcugcuccagagcggcgccgucgugaccaagcccggggccuccgugcgcgucagcugcgaggcguccggcuacaagauccgggacuacuucauccacugguggcgccaggccccggggcagggccugcagugggugggguggaucaacccccagaccggccagcccaacaucccccggccguuccagggccgcgugacgcugacccggcacgccagcugggacuucgacaccuucuccuucuacauggaccucaaggcccugcgcagcgacgacaccgccaucuacuucugcgcgcggcgccgguccgacuacugcgacuucgacgucugggggagcggcacgcacgugaccguguccagc

SEQ ID NO: 11824 - RNA, 369 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggggcugcgcuccgacgacaccgccaucuacuucugcgcgcggcagcgcagcgacuacugggacuucgacguguggggcuccgggacccaggucacggugagcucc

SEQ ID NO: 11825 - RNA, 369 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcuguuccagggccgcgugagccucacgcggcacgccuccugggacuucgacaccuucagcuucuacauggaccugaaggccgugcgcuccgacgacaccgcggucuacuucugcgcccggcagcgcagcgacuacugggacuucgacguguggggguccggcacccaggugacggucagcucc

SEQ ID NO: 11826 - RNA, 369 nt, Artificial Sequence
  derived and/or modified sequence opt1 from anti-HIV_Chain
caggugcgccugcuccagagcggcgccgccgucaccaagcccggggcguccgugcgggugagcugcgaggccuccggcuacgagauccgcgacuacuucauccacugguggcggcaggccccggggcagggccugcagugggucggguggaucaaccccaagaccggccagcccaacaacccccgccaguuccagggccgggugagccugacgcgccaggccuccugggacuucgacagcuacuccuucuacauggaccucaaggcccugcggagcgacgacaccgggguguacuucugcgcgcgccagcgguccgacuacugggacuucgacgucuggggcagcgggacccaggugaccguguccagc

SEQ ID NO: 11827 - RNA, 369 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggcccugcgcuccgacgacaccgcgguguacuucugcgcccggcagcgcagcgacuacugggacuucgacgucuggggguccggcacccaggugacggugagcucc

SEQ ID NO: 11828 - RNA, 369 nt, Artificial Sequence
  derived and/or modified sequence opt1 from anti-HIV_Chain
gaggugcagcuggucgagagcggcgggggccucauccagcgcgggggcucccugcggcugagcugcguggccuccggguuccccgugagcgacaaccacauguccuggguccgccaggccccgggcaagggccucgagugggugagcaucaucuacuccgacgggggcaccuacuacgcggacagcgugaaggggcgguucaccaucucccgcgacaacagcaagaacacggucuaccugcagaugaacucccugcgggccaccgacaccgccguguacuacugcgcccgcgaccccggcuuccacuacgggcucgacguguggggccagggcaccacggucaccgugagcuccgccagcaccaagggg

SEQ ID NO: 11829 - RNA, 369 nt, Artificial Sequence
  derived and/or modified sequence opt1 from anti-HIV_Chain
caggugcagcugcaggagagcggccccgggcuccugcgcccgcuggagacccucucccugaccugcagcgucuccggcgggagcauccggggcuacuucugguccugggugcgccagcccgccgggcggggccuggaguggaucggccgcaucuacagcuccgggacgacccgguucaaccccagccucaagucccgcgugcggcugagcaucgacaccgccaaguccgaggucagccugaacaucaccuccgugacggcggccgacagcgccuccuacuucugcgccggcaccagccccgugcacgggggccucgaccugugggggcugggccuccgcgucaccguguccagcgccuccaccaagggc

SEQ ID NO: 11830 - RNA, 369 nt, Artificial Sequence
  derived and/or modified sequence opt1 from anti-HIV_Chain
gagaucgugcugacccagagccccggcacccucucccugagcccgggggagcgcgccacgcuguccugccgggccagccaguccgucagcuccaaccucgcgugguacgcccagaagcccggccaggcgccccgccugaucaucuacggggccagcucccgggccagcgccauccccgaccgcuuccggggcuccgggagcggcaccgacuucacccugaccaucucccgccucgagccggaggacuucgccguguacuacugccagcaguacgacgacgcccccaucacguucggccacgggacccggcuggagaucaagcgcaccguggccgcgcccagcgucuucaucuucccgcccuccgacgag

SEQ ID NO: 11831 - RNA, 369 nt, Artificial Sequence
  derived and/or modified sequence opt1 from anti-HIV_Chain
gagaucgugcugacccagagccccggcacccucucccugagcccgggggaccgcgccgcccuguccugccgggcgagcgagacgcucuccggcaacagccuggccugguaccagcagaagcgcgggcagccgccccggcugcucaucuucgccgccuccagccgcgccaccggcauccccgagcgguucuccgggggcggcagcgggaccgacuucacccugacgaucacccgccuggagcccgaggacuucgcggucuacuucugccagcaguacguggacgcccccaucaccuucggccaggggacccggcucgagaucaagcgcacgguggccgcccccuccgucuucaucuucccgcccagcgac

SEQ ID NO: 11832 - RNA, 369 nt, Artificial Sequence
  derived and/or modified sequence opt1 from anti-HIV_Chain
gacauccagaugacccagagccccuccagccuguccgccagcgugggcgaccgcgucaccaucacgugccgggccucccaggacaucaccaccuaccucgcguggcugcagcagaagcccgggaaggcccccaagagccugaucuacuccgccagcaccgugcaguccggcgugcccagccgcuucuccgggagcggcuccgggacggaguucacccucaccaucagcggccugcagcccgaggacuucgccaccuacuacugccagcaguacaacuacuacccgaucacguucggccuggggacccggcucgagaucaagcgcaccgucgccgcgcccuccguguucaucuucccgcccagcgacgag

SEQ ID NO: 11833 - RNA, 369 nt, Artificial Sequence
  derived and/or modified sequence opt1 from anti-HIV_Chain
gacauccagaugacccagagccccuccagccuguccgccagcaucggcgaccgcgugaccaucacgugccgggccaaccagcacauccgcuccuuccucaacugguaccagcagacccccgggaaggcgcccaagcugcugaucuacgccgccagcacccuccagcggggcguccccucccgcuucagcggguccggcagcgggaccgacuucacgcugaccaucaccucccuggagcgggaggaccucgccaccuacuacugccagcagacguacaccagccccaucaccuucggccagggcacccgccuggagaucaagcggacgguggccgcgccguccguguucaucuucccgcccagcgacgag

SEQ ID NO: 11834 - RNA, 369 nt, Artificial Sequence
  derived and/or modified sequence opt1 from anti-HIV_Chain
agcgagaucgugcugacccagucccccgccacccucagccugucccccggcgagagcgccacgcuguccugccgcgcgagccagucccucagcuccagccuggccugguaccagcagaagcccgggcaggcgccccggcugcucaucuacgacaccuccgaccgcgccaccggcauccccgcccgguucagcgggcgcggcuccgggaccgacuucacgcugaccaucagcucccuggagccggaggacuucgccgucuacuacugccagcagcggagcaacugggccaucaccuucggccagggcacccgccucgagaucaagcggacgguggccgcccccuccguguucaucuucccgcccagcgac

SEQ ID NO: 11835 - RNA, 369 nt, Artificial Sequence
  derived and/or modified sequence opt1 from anti-HIV_Chain
caggugcugagcgucuccggcacccccgggcagcgcgugaucaucagcugcuccggcaccagcuccaacgucgggggcaaccucgugagcugguaccagcaccucccgggggccgcgccccggcugcugauccaccgcgacgaccagcggcccuccggcgugcccgaccgcuucagcggcuccaagagcgggaacuccgccagccuggugaucuccggccugcggagcgacgacgaggccgacuacuucugcgccgccuacgacuccacguucagccucccggucuucgggggcgggacccgccugaccgugcugucccagcccaaggccgcgcccagcgugacccucuacgcccccuccagcgaggag

SEQ ID NO: 11836 - RNA, 369 nt, Artificial Sequence
  derived and/or modified sequence opt1 from anti-HIV_Chain
gacauccagaugacccagagccccuccagccuguccgccagcgugggcgaccgcgucaccaucacgugccaggccgggcagggcaucggguccagccuccagugguaccagcagaagcccggcaaggcgcccaagcugcuggugcacggggccuccaaccuccaccggggcgugcccagccgcuucuccggcagcggguuccacaccaccuucucccugaccaucagcggccugcagcgggacgacuucgccacguacuucugcgccguccucgaguucuucgggcccggcaccaagguggagaucaagcgcaccguggccgcgccguccgucuucaucuucccgcccagcgacgagcagcugaagucc

SEQ ID NO: 11837 - RNA, 369 nt, Artificial Sequence
  derived and/or modified sequence opt1 from anti-HIV_Chain
gagaucgugcugacccagagccccgccacccucucccugagccccggcgagcgcgccacgcuguccugccgggcgagccaggggcucaacuucgucgugugguaccagcagaagcgcggccaggcgccccggcugcugauccacgcccccuccgaccgcgcccccggggugccggaccgguucagcgcccgcggcuccgggaccgacuucagccucgucaucuccagcguggagcccgacgacuucgccaucuacuacugccaggaguacuccagcacccccuacaacuucggccccggcacccggguggaccgcaagcggacggucgccgccccguccguguucaucuucccgcccagcgacgagcag

SEQ ID NO: 11838 - RNA, 369 nt, Artificial Sequence
  derived and/or modified sequence opt1 from anti-HIV_Chain
gagaucgugcugacccagagccccaccacgcucucccugagcccgggcgagcgcgccacccuguccugccgggccagccagggggucaaccucguggugugguaccagcagaagcgcggccaggcgccccggcugcugaucuacgggcccuccgaccgcgcccccggcgucccggaccgguucagcgcccgcggguccggcaccgaguucagccucgugaucuccagcguggagcccgacgacuucgcccuguacuacugccaggaguacuccagcacccccuacaacuucggcacggggacccgggucgaccgcaagcggaccguggccgcgcccuccguguucaucuucccgcccagcgacgagcag

SEQ ID NO: 11839 - RNA, 369 nt, Artificial Sequence
  derived and/or modified sequence opt1 from anti-HIV_Chain
gagaucgugcugacccagagccccgccacccucucccugagccccggcgagcgcgccacgcuguccugccgggcgagccagggggucaacuucguggugugguaccagcagaagcgcggccaggcgccccggcuccugaucuacgggcccuccaaccgcgcccccggcgucccggaccgguucagcgcccgcggguccggcaccgaguucagccuggugaucuccagcguggagcccgacgacuucgcccucuacuacugccaggaguacuccagcacccccuacaacuucggccccgggacccgggucgaccgcaagcggacgguggccgccccguccguguucaucuucccgcccagcgacgagcag

SEQ ID NO: 11840 - RNA, 369 nt, Artificial Sequence
  derived and/or modified sequence opt1 from anti-HIV_Chain
gagaucgugcugacccagagccccgccacccucucccugagccccggcgagcgcgccacgcuguccugccgggcgagccaggggcucaacuucgucgugugguaccagcagaagcgcggccaggcgccccggcugcugauccacgggcccucccaccgcgcccccggcgugccggaccgguucagcgcccgcggguccggcaccgaguucagccucgucaucuccagcguggagcccgacgacuucgccaucuacuacugccaggaguacuccagcacccccuacaacuucggccccgggacccggguggaccgcaagcggacggucgccgccccguccguguucaucuucccgcccagcgacgagcag

SEQ ID NO: 11841 - RNA, 369 nt, Artificial Sequence
  derived and/or modified sequence opt1 from anti-HIV_Chain
gagaucgugcugacccagagccccgccacccucucccugagccccggcgagcgcgccacgcuguccugccgggcgagccaggggcucaacuucgucgugugguaccagcagaagggcgggcaggcgccccgccugcugauccacggccccaccgaccgggcccccggggugccggaccgcuucuccgcccggggcagcggcaccgaguucucccucgucaucagcuccguggagcccgacgacuucgcccuguacuacugccaggaguacagcuccacccccuacaacuucgggcccggcacgcgcguggaccggaagcgcaccgucgccgccccgagcguguucaucuucccgcccuccgacgagcag

SEQ ID NO: 11842 - RNA, 369 nt, Artificial Sequence
  derived and/or modified sequence opt1 from anti-HIV_Chain
gagaucgugcugacccagagccccgccacccucucccugagccccggcgagcgcgccacgcuguccugccgggcgagccaggggcucaacuucgucgugugguaccagcagaagcgcggccaggcgccccggcugcugauccacgcccccuccgggcgcgcccccggcgugccggaccgguucagcgcccgcggguccggcaccgaguucagccucgucaucuccagcguggagcccgacgacuucgccaucuacuacugccaggaguacuccagcacccccuacaacuucggccccgggacccggguggaccgcaagcggacggucgccgccccguccguguucaucuucccgcccagcgacgagcag

SEQ ID NO: 11843 - RNA, 369 nt, Artificial Sequence
  derived and/or modified sequence opt1 from anti-HIV_Chain
caggugcagcugguccagagcggcgccgaggugaagaagcccggguccagcgugaaggucuccugcaagaccagcggcggguccuucagcaacuacgccuucuccugggugcgccaggcgcccggcgaggggcucgaguggaugggccggaucauccccaucuucggcaccgccaaguacacgcagaagcugcaggggcgcgugaccaucaccgccgacaaguucaccagcacggucuacauggagcuguccagccuccgguccgaggacaccgccaucuacuacugcgccagccugcaccagggccccaucggguacacccccuggcacccgccgccccgcgcgccccugggccaguccgugugcggg

SEQ ID NO: 11844 - RNA, 369 nt, Artificial Sequence
  derived and/or modified sequence opt1 from anti-HIV_Chain
caggugcagcuggucgagagcggcgggggccucgugcagcccgggggcucccugcgcaucagcugcuccgccaccggguucaccuucagcacgcacgccaugcacugggugcggcaggcgccgggcaagggccuggaguacgucuccgccaucaacagcaacgggcgcuccgccuucuacgccgacagcgugaagggccgggugaccaucucccgcgacaacagcaagaacacccucuuccugcagaugaccucccugcgggccgaggacacggcggucuacuacugcgugaaggggccccuccugcgcuaccuggacagcuggggccaggggacccucgugaccgucuccagcgccuccaccaagggc

SEQ ID NO: 11845 - RNA, 369 nt, Artificial Sequence
  derived and/or modified sequence opt1 from anti-HIV_Chain
gaggugcagcuggucgagagcggcgggggccucgugcagcccgggggcucccugcgcaucagcugcuccgccaccggguucaccuucagcacgcacgccaugcacugggugcggcaggcgccgggcaagggccuggaguacgucuccgccaucaacagcaacgggcgcuccgccuucuacgccgacagcgugaagggccgggugaccaucucccgcgacaacagcaagaacacccucuuccugcagaugaccucccugcgggccgaggacacggcggucuacuacugcgugaaggggccccuccugcgcuaccuggacagcuggggccaggggacccucgugaccgucuccagcgccuccaccaagggc

SEQ ID NO: 11846 - RNA, 369 nt, Artificial Sequence
  derived and/or modified sequence opt1 from anti-HIV_Chain
gaggagagcggccccgggcuggugaagccgucccagacccucagccugaccugcuccgucagcggcgacuccgugagcuccgggggcuacuucuggagcuggauccgccagcaccccacgaaggggcuggagugccucggcuacguguacuacaccggcaacaccuacuacaaccccucccugaaguccccgcccaccaucgaggucgccauggccaacaaccaggugagccugaagcucgggagcgugacggcggccgacaccgccgucuacuacugcgcccggaucaagcgcuuccggggcgggaacuacuucgacaccuggggccacgggcugcuggugaccguguccagcgccuccacgaagggc

SEQ ID NO: 11847 - RNA, 369 nt, Artificial Sequence
  derived and/or modified sequence opt1 from anti-HIV_Chain
caggugcagcugcaggagagcggcuccgggcucgucaagcccagcggcacccugucccugaccugcgccgugagcaacgggccgaucuccagcggcaacuggugguccugggugcgccagacgcccgagaaggggcucgaguggaucggcgaggucuaccacagcggcuccaccaaccacaaccccagccugaagucccgggccaccauccugguggacaagagcaagaaccaguucucccucaaccugcgcagcgugaccgcggccgacacggccgucuacuacugcgcccgggugcgcggguccuggaacuucgacuacuggggccaggggauccuggugaccgucagcuccgccagcaccaagggc

SEQ ID NO: 11848 - RNA, 369 nt, Artificial Sequence
  derived and/or modified sequence opt1 from anti-HIV_HeavyChain
gaggugcagcugcagcagagcggcaccguccucgcccgccccggggccuccgugaagaugagcugcaaggcguccggcuacaccuucacgagcuacuggaugcacugggugaagcagcggccggggcagggccuggaguggaucggggccaucuaccccggcaacuccgacaccagcuacaaccagaaguucaagggcaaggccaagcugaccgccgucaccuccgccagcacggcguacauggagcucuccagccugaccaacgaggacuccgccguguacuacugcacccgcuggccccacuacuacgggggcagccgguacuacuucgacuacugggggcagggcaccacgcugaccguguccagc

SEQ ID NO: 11849 - RNA, 372 nt, Artificial Sequence
  derived and/or modified sequence opt1 from anti-HIV_Chain
gugguccagcugguggagagcggcgggggccucgugcagcccgggggcucccugcgccugagcugcgccgccuccggguucgcguuccggagcuacuggauguccuggguccgccaggccccgggccggggccucgaguggguggccaacaucaagcaggacgggagcgagaaguacuacgccgacuccgugaagggccgcuucaccaucagccgggacaacaccaagaacucccuguaccugcagaugaacagccuccgcgccgaggacacggcggucuucuacugcgccucccgcggggaccgguacggccccaucgacuacugggggcagggcacccuggugaccgugagcuccgccagcaccaagggc

SEQ ID NO: 11850 - RNA, 372 nt, Artificial Sequence
  derived and/or modified sequence opt1 from anti-HIV_Chain
caggugcagcugguccagagcggcgccgagaucaagaagcccggggagucccucaagaucagcugcaaggccuccggcuacaccuucaacgacuacuggaucgggugggugcgccagaugccgggcaaggggcuggaguggaugggcaucuucuaccccgacgacagcgacuccaacuacagccccuccuuccagggccgggugaccaucagcgcggacaaguccaucacgaccgccuaccugcaguggagcacccucaaggccuccgacagcgccauguacuucugcgcccgccugcugggggacuccggcgcguucgacaucugggggcagggcaccauggucaucgugagcuccgccagcacgaagggg

SEQ ID NO: 11851 - RNA, 372 nt, Artificial Sequence
  derived and/or modified sequence opt1 from anti-HIV_Chain
caggugcagcugguccagagcggcgggggccucgugaagcccgggggcucccugcgccugagcugcgccgccuccggguucaccuucagcuccuacagcaugaacugggugcggcaggcgccgggcaagggccucgagugggucuccagcaucuccagcuccagcuccuacaucuacuacgccgacagcgugaaggggcgcuucaccaucucccgggacaacgccaagaacagccuguaccugcagaugaacucccuccgcgccgaggacacggccguguacuacugcgcgcgggagggcagcuacuacuacgggauggacgucuggggccaggggaccaccgugaccguguccagcgccagcacgaagggc

SEQ ID NO: 11852 - RNA, 372 nt, Artificial Sequence
  derived and/or modified sequence opt1 from anti-HIV_Chain
gagaucgugcugacccagagccccgccacccucuccgucagccccggcgagcgcgccacgcuguccugccgggcggggcagagcguguccagcgaccuggccugguaccagcacaagcccggccaggcgccccgccuccugaucuacgacgccuccaagcgggccaccgggauccccgcccgcuucagcggcuccgggagcggcaccgacuucacccugacgaucuccagccucgagccggaggacuucgccguguacuacugccagcaccggaccaacuggccgcccuccaucaccuucggccaggggacccgccuggagaucaagcggacggucgccgcccccagcguguucaucuucccgcccuccgac

SEQ ID NO: 11853 - RNA, 372 nt, Artificial Sequence
  derived and/or modified sequence opt1 from anti-HIV_Chain
gagaucgugcugacccagagccccggcacccucucccugagcccgggggagcgcgccacgcuguccugccgggccagccaguccgucagcucccgcuaccucgcgugguaccagcagaagcccggccaggcgccccggcugaucaucuacgacgccagcucccgcgccagcgggauccccgaccgguucuccggcagcggguccgagaccgacuucacccugaccaucacgcgccucgagccggaggacuucgccguguacuacugccagcuguacggcaccagccccaaguucaccuucggccaggggaccaagcuggagaucaagcggacgguggccgcccccuccgucuucaucuucccgcccagcgac

SEQ ID NO: 11854 - RNA, 372 nt, Artificial Sequence
  derived and/or modified sequence opt1 from anti-HIV_Chain
gagaucgugcugacccagagccccggcacccucucccugagccccggggagcgcgccacgcuguccugccgggccagccaguccgucagcaacaacuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacgccaccuccagccuguacaccuucgggcagggcaccaagcucgagaucaagcgcacgguggccgcccccuccgucuucaucuucccgcccagcgac

SEQ ID NO: 11855 - RNA, 372 nt, Artificial Sequence
  derived and/or modified sequence opt1 from anti-HIV_Chain
cccgccacccuggccgugagcccgggcgagcgcgcgaccaucuccugcaagagcucccagaaccuccuguacagcgccaacaaccagcacucccuggccugguaccagcagcggcccgggcagccccccaagcuccugcuguacugggccagcacgcgccucuccggcgucccggaccgguucagcggguccggcagcgggaccgacuucacccugaccaucuccaaccugcaggccgaggacguggcgguguacuacugccagcaguacuacagccccccccccacguucggccagggcaccaaggucgagauccgccggaccguggccgccccguccguguucaucuucccccccagcgacgagcagcuc

SEQ ID NO: 11856 - RNA, 372 nt, Artificial Sequence
  derived and/or modified sequence opt1 from anti-HIV_Chain
cagcccgugcugacccagccgcccagcgccuccggcgcccccgggcagcgcgucaccaucagcugcuccggcgggcccagcaacgugggcgggaacuacguguacugguaccggcaguucccgggcacggcgcccaaccuccugauccugcgcgacgaccagcggcccuccggcguccccgaccgcuucagcgccuccaagagcgggaacuccgccagccucgccaucaccggccugcggccggacgacgaggccuucuacuucugcgcgaccuacgacuccgacgggagcauccgccuguucggcgggggcaccgcccucacggugcugucccagcccaaggccgcccccagcgugacccuguucccgccc

SEQ ID NO: 11857 - RNA, 372 nt, Artificial Sequence
  derived and/or modified sequence opt1 from anti-HIV_Chain
aacuucaugcugacccagcccccgagcgccuccggcgcccccgggcagcgcgugaccaucagcugcuccggcgggcccagcaacgucggcgggaacuacguguacugguaccggcaguuccccggcacggcgcccaaccuccugauccugcgcgacgaccagcggcccuccggcgugcccgaccgcuucagcgccuccaagagcgggaacuccgccagccucgccaucuccggccugcggcccgacgacgaggccuucuacuucugcgcgaccuacgacagcgacggguccauccgccuguucggcgggggcaccacccucacgguccugagccagccgaaggccgcccccuccgugacccuguucccgccc

SEQ ID NO: 11858 - RNA, 372 nt, Artificial Sequence
  derived and/or modified sequence opt1 from anti-HIV_Chain
gacauccagaugacccagagcccgcccucccugagcgccuccgugggcgaccgcgucaccaucacgugccaggccagccaggacaucaacaacuuccucaacugguaccagcagaagcccgggaaggcgccccggcugcugaucuacgacgccuccaaccucgagagcggcguguccagccgcuucuccgggagccgguccggcaccgacuucacccugaccaucagcucccugcuccccgaggacaucgccacguacagcugccagcaguacuccaaccugcccuacaccuucagccaggggaccaagcuggagaucaagcgcaccguggccgcccccuccgucuucaucuucccgcccagcgacgagcag

SEQ ID NO: 11859 - RNA, 372 nt, Artificial Sequence
  derived and/or modified sequence opt1 from anti-HIV_Chain
caggugcagcugguccagagcggcaccgccgugaagcgccccggggccuccgugcgggucagcugccaggcguccggcuacaccuucaucgaccacuucaucuacugguggcgccaggccccggggcagggccucgaguggcugggguggaucaacccccugacgagccagcccuccuaccccagccgguuccagggccgccucacccugacccgggacaccuucgacgagaugcuguacauggaccuccgcggccugcgguccgacgacacggggaucuacuucugcgcccgccggcacagcgacuacugcgacuucgacaucuggggcuccgggacccagaucaucgugagcuccgccagcaccaagggc

SEQ ID NO: 11860 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccaggccuacggcuacaaguucaccgaccaccugaucuacugguggcggcaggccccggggcagggccucgaguggaucggguggaucaagcccgagaccggccagcccuccuacagcuacaaguuccagggccgcgugucccugacgcgggacaccuuccaggagauccuguucauggaccuccgcgggcugcggagcgacgacaccgccaucuacuucugcgcccgccggcacuccgacuacugcgacuucgacguguggggcagcgggucccaggucaucgugagcuccgcgagcaccaagggc

SEQ ID NO: 11861 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccagaccuacggcuacaaguucaccgaccaccugaucuacugguggcggcaggccccggggcagggccucgaguggaugggguggaucaagcccgagacgggccagcccuccuacagcuaccgcuuccagggccgggugucccugacccgcgacaccuucgaggagaucguguucauggaccugcgggggcuccgcagcgacgacaccgccaucuacuucugcgcccggcgccacuccgacuacugcgacuucgacgucuggggcagcgggucccaggugaucgugagcuccgccagcacgaagggc

SEQ ID NO: 11862 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccagaccuacggcuacaaguucaccgaccaccugaucuacugguggcggcaggccccggggcagggccucgaguggaucggguggaucaagcccgagacgggccagcccuccuacagcuaccgcuuccagggccgggugucccugacccgcgacaccuucgaggagaucgccuucauggaccugcgggggcuccgcagcgacgacaccgccaucuacuucugcgcccggcgccacacggacuacugcguguucgacgucuggggcuccgggagccagaucaucguguccagcgcguccaccaagggc

SEQ ID NO: 11863 - RNA, 372 nt, Artificial Sequence
  derived and/or modified sequence opt1 from anti-HIV_Chain
caggugcagcugguccagagcggcaccgccgugaagcgccccggggccuccgugcgggucagcugccaggcguccggcuacaccuucacggacuacuucaucuacugguggcgccaggccccggggcagggccucgaguggcugggguggaucaacccccugaccagccagcccuccuaccccagccgguuccagggccgccucacccugacccgggacacguucgacgagaugcuguacauggaccuccgcggccugcgguccgacgacaccgggaucuacuucugcgcccgccggcacagcgacuacugcgacuucgacaucuggggcuccgggacccagaucaucgugagcuccgccagcaccaagggc

SEQ ID NO: 11864 - RNA, 372 nt, Artificial Sequence
  derived and/or modified sequence opt1 from anti-HIV_Chain
caggugcagcugguccagagcggcgccgcccucaagaagcccggggcguccgugcgcaucagcugccaggccuacggcuacaaguucaccgaccaccugaucuacugguggcggcaggccccggggcagggccuggaguggaucggguggaucaagcccgagaccggccagcccuccuacgccuacaaguuccagggccgcgugacgcucacccgggacaccuucgaggagauccacuucauggaccugcgcgggguccggaacgacgacaccgccacguacuucugcgcgcgccggcacagcgacuacugcgacuucgacguguggggcuccgggagccaggugaucgucuccagcgccuccaccaagggc

SEQ ID NO: 11865 - RNA, 372 nt, Artificial Sequence
  derived and/or modified sequence opt1 from anti-HIV_Chain
caggugcagcugguccagagcggcgccgcccucaagaagcccggggcguccgugcgcaucagcugccagaccuacggcuacaaguucaccgaccaccugaucuacugguggcggcaggccccggggcagggccuggaguggaucggguggaucaagcccgagacgggccagcccuccuacagcuaccgcuuccagggccgggugucccucacccgcgacaccuucgaggagaucgucuucauggaccugcgggggcugcgcagcgacgacaccgccaucuacuucugcgcccggcgccacuccgacuacugcgacuucgacguguggggcagcgggucccaggugcucgucagcuccgccagcacgaagggc

SEQ ID NO: 11866 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccagaccuacggcuacaaguucaccgaccaccugaucuacugguggcggcaggccccggggcagggccucgaguggaucggguggaucaagcccgagacgggccagcccuccuacagcuaccgcuuccagggccgggugucccugacccgcgacaccuucgaggagaucguguucauggaccugcgggggcuccgcagcgacgacaccgccaucuacuucugcgcccggcgccacuccgacuacugcgacuucgacgucuggggcagcgggucccaggugcuggugagcuccgccagcacgaagggc

SEQ ID NO: 11867 - RNA, 372 nt, Artificial Sequence
  derived and/or modified sequence opt1 from anti-HIV_Chain
caggugcagcugguccagagcggcgccgcccucaagaagcccggggcguccgugcgcaucagcugccagaccuacggcuacaaguucaccgaccaccugauccacugguggcggcaggccccggggcagggccuggaguggaucggguggaucaagcccgacacgggccagcccuccuacagcucccgcuuccagggccgggugagccucacccgcgacaccuucgaggagaucgucuucauggaccugcgggggcugcgcuccgacgacaccgccaucuacuucugcgcccggcgccacagcgacuacugcgacuucgacguguggggcuccgggagccaggugcucgucuccagcgccuccacgaagggc

SEQ ID NO: 11868 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccagaccuacggcuacaaguucaccgaccaccugaucuacugguggcggcaggccccggggcagggccucgaguggaucggguggaucaagcccgagacgggccagcccuccuacagcuaccgcuuccagggccgggugucccugacccgcgacaccuucgaggagaucguguucauggaccugcgggggcuccgcagcgacgacaccgccaucuacuucugcgcccggcgccacuccgacuacugcgacuucgacgucuggggcagcgggucccaggugaucgugagcuccgccagcacgaagggc

SEQ ID NO: 11869 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccagaccuacggcuacaaguucaccgaccaccugaucuacugguggcggcaggccccggggcagggccucgaguggaucggguggaucaagcccgagacgggccagcccuccuacagcuaccgcuuccagggccgggugucccugacccgcgacaccuucgaggagaucguguucauggaccugcgggggcuccgcagcgacgacaccgccaucuacuucugcgcccggcgccacuccgacuacugcgacuucgacgucuggggcgggggcagccaggugaucguguccagcgccuccacgaagggg

SEQ ID NO: 11870 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccugaccuacggcuacaaguucaccgaccaccucaucuacugguggcggcaggccccggggcagggccuggaguggaucggguggaucaagcccgagacgggccagcccuccuacagcuaccgcuuccagggccgggugucccugacccgcgacaccuucgaggagaucguguucauggaccuccgggggcugcgcagcgacgacaccgccaucuacuucugcgcccggcgccacuccgacuacugcgacuucgacgucuggggcagcgggucccaggugaucgugagcuccgccagcacgaagggc

SEQ ID NO: 11871 - RNA, 372 nt, Artificial Sequence
  derived and/or modified sequence opt1 from anti-HIV_Chain
caggugcagcugguccagagcggcgccacccucaagaagcccggggccuccgugcgcaucagcugccaggcguacggcuacaaguucaccgaccaccugauccacugguggcggcaggccccggggcagggccuggaguggaucggguggaucaagcccgagacgggccagcccuccuacgccuacaaguuccagggccgcgugagccucacccgggacaccuucgaggagauccuguucauggaccugcgcgggcuccgguccgacgacaccgccaucuacuucugcgcccgccggcacagcgacuacugcgaccuggacgucuggggcgggggcacgcagcugcucguguccagcgcguccaccaagggg

SEQ ID NO: 11872 - RNA, 372 nt, Artificial Sequence
  derived and/or modified sequence opt1 from anti-HIV_Chain
caggugcagcugguccagagcggcgccgcccucaagaagcccggggcguccgugcgcaucagcugccaggccuacggcuacaaguucaccgaccaccugaucuacugguggcggcaggccccggggcagggccuggaguggaucggguggaucaagcccgagaccggccagcccuccuacagcuacaaguuccagggccgcgugacgcucacccgggacaccuucgaggagauccacuucauggaccugcgcgggcugcgguacgacgacaccgccacguacuucugcgcccgccggcacuccgacuacugcgacuucgacgucuggggcagcgggucccaggugagcguguccagcgcguccaccaagggc

SEQ ID NO: 11873 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccaggccuacggcuacaaguucaccgaccaccugaucuacugguggcggcaggccccggggcagggccucgaguggaucggguggaucaagcccgagaccggccagcccuccuacagcuacaaguuccagggccgcgugucccugacgcgggacaccuuccaggagauccuguucaugaaccuccgcgggcugcggagcgacgacaccgccaucuacuucugcgcccgccggcacuccgacuacugcgacuucgacguguggggcagcgggucccagauccuggucagcuccgcgagcaccaagggc

SEQ ID NO: 11874 - RNA, 372 nt, Artificial Sequence
  derived and/or modified sequence opt1 from anti-HIV_Chain
caggugcagcugguccagagcggcaccgccgugaagaagcccggggccuccgugcgcgucagcugccaggcguccggcuacaccuucacggacuacuucaucuacugguggcggcaggccccggggcagggccucgaguggcugggguggaucaacccccgcaccagccagcccuccuaccccuaccgguuccagggccgcgugacccugacccgggacaucuucgaggagaugcucuacauggaccugcgcggccugcggagcgacgacacggggaucuacuucugcgcccgccggcacuccgacuacugcgacuucgacaucuggggcagcgggacccagaucaucguguccagcgccuccaccaagggc

SEQ ID NO: 11875 - RNA, 372 nt, Artificial Sequence
  derived and/or modified sequence opt1 from anti-HIV_Chain
caggugcagcugguccagagcggcgccgcccucaagaagcccggggcgucccugcgcaucagcugccaggccuacggcuacaaguucaccgacuaccugauccacugguggcggcaggccccggggcagggccucgaguggaucggguggaucaagcccgagaccggccagcccuccuacagcuacaaguuccagggccgcgugucccugacgcgggacaccuucgaggagauccuguucauggaccuccgcgggcugcggagcgacgacaccgccaucuacuucugcgcccgccggcacuccgacuacugcgacuucgacguguggggcgggggcagccagguccugguguccagcgcguccaccaagggg

SEQ ID NO: 11876 - RNA, 372 nt, Artificial Sequence
  derived and/or modified sequence opt1 from anti-HIV_Chain
gaggugcagcugcucgagagcggcggggcccugguccagcccggcgggucccugcgccucagcugcgccgcguccggcuucaccuucagcaccuccagcauguccugggugcggcaggccccggggaagggccuggagugggugagcgccaucggcuccgggcgcggcagcacguucuacgccgacuccgucaaggggcgguucaccaucagccgcgacaacuccaagaacacccugagccuccagaugaacucccugaccgccgaggacacggcgaccuacuacugcaccaagaccggcgggcugcuccgguuccccgagguguggggcaagggcacgaccgugaccgucagcuccgccagcaccaagggg

SEQ ID NO: 11877 - RNA, 372 nt, Artificial Sequence
  derived and/or modified sequence opt1 from anti-HIV_Chain
gaggugcagcuggucgagagcggcgggggccucgugaagcccgggggcucccugcgccugagcugcgccgacuccggguucaccuuccggagcuacuccaugcacugggugcgccaggccccgggcaagggccucgcgugggucagcuccaucagcuccaccagcaacuacaucuacuacgccgacuccgugaaggggcgguucacgaucagccgcgacaacgccaagaacucccuguaccugcagaugaacagccuccgggccgaggacaccgccguguacuacugcgcgcgcaccuucaucaccgccuccugguucgacagcuggggccaggggacgcuggucaccguguccagcgccuccaccaagggc

SEQ ID NO: 11878 - RNA, 372 nt, Artificial Sequence
  derived and/or modified sequence opt1 from anti-HIV_Chain
caggugcagcugguccagagcggcgccgaggugaagaagcccggggccuccgugaaggucagcugcaaggcguccggcuacaccuucaccaacuacggggugagcugggugcgccaggccccgggccaggggcucgaguggaugggcuggaucucccccuacagcggcaacacgaacuacgcccagcggcugcaggaccgcgucaccaugaccaccgacacguccaccaacaccgccuacauggagcugcggagccuccgcuccgacgacaccgccguguacuacugcgcggcccggagcuacuacuacuacuccauggacgugugggggcagggcacgaccgucaccgugagcuccgccagcaccaagggg

SEQ ID NO: 11879 - RNA, 372 nt, Artificial Sequence
  derived and/or modified sequence opt1 from anti-HIV_Chain
caggugcagcugguccagagcggcgccgagcucaagaagcccggguccagcgugaagguguccugcaaggccagcggcgggaccuucuccaacuacgcgaucaacuggguccgccaggccccgggccagggguucgaguggaugggcggcaucaucccccuguucgccacccccacguacgcccagaaguuccaggggcgggugcgcaucaccgccgacgacagcaccuccaccgcguacauggagcugagcucccuccggagcgacgacacggccguguacuucugcgcccgccccaacgucgugcgguccgcccuggacuacuggggccaggggacccuggugaccgucagcuccgcgagcaccaagggc

SEQ ID NO: 11880 - RNA, 372 nt, Artificial Sequence
  derived and/or modified sequence opt1 from anti-HIV_Chain
caggugcagcuggucgagagcggcgggggcguggugcagcccgggaagucccuccgccugagcugcgccgccuccggcuucaccuucagcacccacgcgaugcacuggguccggcaggccccggggaagggccuggacuggguggccgugaucucccacgacggcgacaaccaguacuacgccgacgccgucaaggggcgcuucacgaucagccgggacgacucccgcgacaccguguuccuccagaugaacagccugcggaccgaggacaccggcguguacuacugcgcggccgacuccagcggguccaacugguucgacuacuggggccaggggauccuggucacggugagcuccgccagcaccaagggc

SEQ ID NO: 11881 - RNA, 375 nt, Artificial Sequence
  derived and/or modified sequence opt1 from anti-HIV_Chain
caggugcgccugagccaguccggcgggcagaugaagaagcccggcgagagcaugcggcucuccugccgcgccagcggguacgaguuccugaacugcccgaucaacuggauccggcuggcccccggccgccggcccgaguggaugggguggcucaagccccgcggcggcgcggucaacuacgcccggaaguuccaggggcgcgugaccaugacccgggacguguacuccgacacggccuuccuggagcugcgcagccucaccuccgacgacaccgccgucuacuucugcacccggggcaaguacugcacggcccgcgacuacuacaacugggacuucgagcacugggggcggggcgcgccggugaccgugagcucc

SEQ ID NO: 11882 - RNA, 375 nt, Artificial Sequence
  derived and/or modified sequence opt1 from anti-HIV_Chain
gaggugcagcugguccagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagc

SEQ ID NO: 11883 - RNA, 375 nt, Artificial Sequence
  derived and/or modified sequence opt1 from anti-HIV_Chain
caggugcagcugguccagagcggcgggggccucgugcagcccggggagucccugcgccugagcugcaccgccuccggcuucaccuucagcuccuacaacaugaacugggugcggcaggccccggggaagggccucgaguggaucagcuacaucuccgacaagagcaagaacaaguacuacgcggacuccguccgcggccgguucacgaucagccgcgacaacgcccagaacucccuguuccugcagaugagcucccuccgggacgaggacaccgccguguacuacugcacccgcgaggggccccagcggagcuucuacuucgacuacuggggccaggggauccaggugaccgucuccagcgccuccacgaagggc

SEQ ID NO: 11884 - RNA, 375 nt, Artificial Sequence
  derived and/or modified sequence opt1 from anti-HIV_Chain
gaggugcagcuggucgagagcggcgccgaggugaagaagcccggguccagcgugaaggucuccugcaaggccagcggcgggaccuucuccagcuacuccaucagcugggugcgccaggcgccgggccaggggcucgaguggaugggcggcaucauccccaucuucgccaccacgcacuacgggcagaaguuccagggccggaucaagaucaccgccgacaaguccaccagcaccgccuacauggagcugucccgccugcggagcgaggacacggccguguacuacugcgcgcgcgaccgggaguucuacuucuacgggauggacgucuggggccaggggaccaccgugaccguguccagcgccuccacgaagggc

SEQ ID NO: 11885 - RNA, 375 nt, Artificial Sequence
  derived and/or modified sequence opt1 from anti-HIV_Chain
cagcugcagcuccaggagagcggccccgggcuggugaagccgugggagacccugguccugaccugcuccgugagcggcggguccaucagcuccggcgacuacuacuggggguggauccgccagagccccggcaagggccccgaguggaucgggaacaucuucuacuccagcggcaacacguacuacaacaccucccucaagagccgggugaccaucuccgucgacgugagcaagaaccgcuucucccugaagcucaccagcaugacggccgccgacaccgcgguguacuacugcgggcggcuguccaacaagggcugguucgaccccugggggcagggcacccuggucagcguguccagcgccuccaccaagggc

SEQ ID NO: 11886 - RNA, 375 nt, Artificial Sequence
  derived and/or modified sequence opt1 from anti-HIV_Chain
gagaucgugcugacccagagccccgccacccucucccugagcccgggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgacaccgacuucacccucacgaucagcucccuggagccggaggacuucgccguguacuacugccagcagcgggggaucuggccccugcagaucaccuucggccagggcacccgccucgagaucaagcggaccguggccgcccccagcgucuucaucuucccgcccuccgacgag

SEQ ID NO: 11887 - RNA, 375 nt, Artificial Sequence
  derived and/or modified sequence opt1 from anti-HIV_Chain
agcgagaucgugcugacccagucccccggcacccucagccuguccccgggggagcgcgccacgcugagcugccgggccucccagagcgucuccagcuccuaccucgcgugguaccagcagaagcccgugcaggcgccccgccugcugaucuacggcgccagcucccgggccaccgggauccccgaccgcuucagcggcuccgggagcggcaccgacuucacccucacgaucucccggcuggagccggaggacuucgccguguacuacugccagcaguacggcacccugcacccccgcaccuucgggcagggcaccaaggucgagaucaagcggacgguggccgcccccagcguguucaucuucccgcccuccgac

SEQ ID NO: 11888 - RNA, 375 nt, Artificial Sequence
  derived and/or modified sequence opt1 from anti-HIV_Chain
agccaggccguggucacccagcccccguccgugagcggcgcccccgggcagcgcgugaccaucuccugcagcggcgggcccuccaacgucggcgggaaccugguguacugguacaagcaguuccccggcacggcgcccaagcuccugauccggcgcgacgaccagcggcccagcggcgugcccgaccgcuucuccgggagcaaguccggcaacagcgccucccuggccaucagcgggcuccggcccgacgacgaggccuucuacuucugcgccaccuacgacucccacggcagcauccgccuguucgggggcggcacccugcucaccguccugucccagccgaaggcggcccccagcgugacgcuguucccgccc

SEQ ID NO: 11889 - RNA, 375 nt, Artificial Sequence
  derived and/or modified sequence opt1 from anti-HIV_Chain
gacauccagaugacccagagccccuccacccuggccgccagcaucggcgggacggugcgcgucuccugccgggcgagccaguccaucaccggcaacuggguggccugguaccagcagcgccccgggaaggcgccccggcuccugaucuaccgcggcgccgcccugcucgggggcgugcccagccgguucuccggcagcgccgccgggaccgacuucacccugacgaucggcaaccugcaggccgaggacuucgggaccuucuacugccagcaguacgacaccuaccccggcaccuucgggcagggcacgaaggucgaggugaagcgcaccguggccgcgccguccgucuucaucuucccgcccagcgacgagcag

SEQ ID NO: 11890 - RNA, 375 nt, Artificial Sequence
  derived and/or modified sequence opt1 from anti-HIV_Chain
gagaucgugaugacccagagccccgacacccuguccgucagccccggcgagcgcgccacgcucuccugccgggccagccaguccgugaacagcaaccuggcgugguaccagcagaagcccgggcaggcgccccgccugcucaucuacggcgccuccacccgggccaccgccgugcccgcccgcuucagcggguccggcagcgggaccgaguucacgcugaccaucuccagccugcaguccgaggacagcgccgucuacuacugccagcaguacuaccaguggcucuccuacaccuucggccagggcaccaagcuggagaucaagcggacgguggccgccccgagcguguucaucuucccgcccuccgacgagcag

SEQ ID NO: 11891 - RNA, 375 nt, Artificial Sequence
  derived and/or modified sequence opt1 from anti-HIV_Chain
cgccaggugcagcugguccagagcggcgccgcccucaagaagcccggggcgucccugcggaucagcugccaggccuacggcuacaaguucaccgaccaccugaucuacugguggcgccaggccccggggcagggccucgaguggaucggguggaucaagcccgagaccggccagcccuccuacagcuacaaguuccagggccgggugucccugacgcgcgacaccuuccaggagauccuguucauggaccuccgggggcugcgcagcgacgacaccgccaucuacuucugcgcccggcgccacuccgacuacugcgacuucgacguguggggcagcgggucccagauccuggucagcuccgcgagcaccaagggc

SEQ ID NO: 11892 - RNA, 375 nt, Artificial Sequence
  derived and/or modified sequence opt1 from anti-HIV_Chain
caggugcagcugguccagagcggcgccgcccucaagaagcccggggcguccgugcgcaucagcugccaggccuacggcuacaaguucaccgacuaccugauccacugguggcggcaggccccggggcagggccuggaguggaucggguggaucaagcccgagaccggccagcccuccuacagcuacaaguuccagggccgcgugacgcucacccgggacaccuucgaggagauccuguucauggaccugcgcgggcuccgguccgacgacaccgccaucuacuucugcgcccgccggcacagcgacuacugcgacuucgacgucuggggcuccgggagccaggugaucguguccagcgcguccacgaagggcgcc

SEQ ID NO: 11893 - RNA, 375 nt, Artificial Sequence
  derived and/or modified sequence opt1 from anti-HIV_Chain
gaggugcagcuggucgagagcggcgggggccucgugaagcccgggggcucccugcgccugagcugcgccgccuccggguucagcuucuccgagcacuacaugagcuggauccggcucgcgccgggcaagggccuggaguggcuguccuacaucagcuccagcacccgcaccacguacuccgccgacagcgugcgggggcgcuucaccaucucccgggacaccgccaagcagcuccuguuccugcacaugagcucccuccgcgccgaggacaccgccgucuacuacugcgugcggcuguacggcgggaucaacggcugguucgaccagugggggcagggcacgcuggugagcgucuccagcgcguccaccaagggc

SEQ ID NO: 11894 - RNA, 375 nt, Artificial Sequence
  derived and/or modified sequence opt1 from anti-HIV_Chain
caggugcagcugguccagagcggccccgggcucgugaagccguccgagacccugagccugaccugcuccgugagcaacggcuccaucagcuccgggggcuacuacuggagcuggcuccgccaguuccccgggaagggccuggaguggaucggcuccauccacuacacggggcggaccuucuacaaccccagccugaugggccgcaccgcccucuccauggacaccagcaacaaccaguucucccugaaggucagcuccgugacggccgcggacaccgcccuguacuacugcgcccgggagcuccaguggauguucguggucgaccccugggggcagggcacccuggugaccgugagcuccgccagcacgaagggg

SEQ ID NO: 11895 - RNA, 375 nt, Artificial Sequence
  derived and/or modified sequence opt1 from anti-HIV_Chain
caggugcagcugcaggagagcggccccgggcucgucaagccguccgagacccugagccugaccugcuccgugagcaacggcuccaucagcuccgggggcuacuacuggagcuggcuccgccaguuccccgggaagggccuggaguggaucggcuccauccacuacacggggcggaccauguacaaccccagccugaugggccgccccgcccucuccauggacaccagcaacaaccaguucucccugaagcugcggagcgugaccgccgcggacacggcccucuacuucugcgcccgcgaccugcaguggaucuucgucguggacccgugggggcagggcacccuggugaccgucuccagcgccuccaccaagggg

SEQ ID NO: 11896 - RNA, 375 nt, Artificial Sequence
  derived and/or modified sequence opt1 from anti-HIV_Chain
gaggugcagcugcucgagagcggcgggggccugguccagcccgggggcucccugcgccucagcugcgccguguccggguucaccuucggcggccacgccgugagcuggguccggcaggcgccggggaagggccuggaguggcugucccagaucagcgggaccggcucccgcacggacuacgccgacgccgugaaggggcgguucaccgugagccgcgacaacuccaagaagaccgucuaccuccagaugaacagccugcggguggaggacaccgcccuguucuacugcgccacgcgcucccccggcggcggguacgcguucgacaucuggggccagggggccauggugaccgucagcuccgccagcaccaagggc

SEQ ID NO: 11897 - RNA, 375 nt, Artificial Sequence
  derived and/or modified sequence opt1 from anti-HIV_Chain
caggugcagcugguccagagcggcgccgaggugaagaagcccggguccagcgugaaggucuccugcaaggugagcuucuucuccaacuacggcaucagcugggugcgccagcggccggggcagggccucgaguggauggggcgcaucauccccgccaucgacgacaugaccuacgcgcagaccuuccggggccgcgucacguucuccgccgacaaguucaccaccaccgccuacauggagcugacgggccugaccuucgaggacaccgccaccuacuucugcgcccgggacccccaggugaaccgccgggggaacugcuucgaccacuggggccaggggacgcucgugaccgucagcuccgcgagcaccaagggc

SEQ ID NO: 11898 - RNA, 375 nt, Artificial Sequence
  derived and/or modified sequence opt1 from anti-HIV_Chain
caggugcagcugcaggagagcggccccgggcucgucaagcccuccgagacccugagccugaccugcacgguguccggcgggagcaucuccuacuacuacuggagcuggauccgccagccgcccggcaaggggcucgaguggaucggcgacaucuacuacuccggcaccaccgacuacaaccccagccugaagucccgggugaccaucagcgucgacacguccaagaaccaguucagccugaagcucuccagcgugaccgccgccgacaccgcgguguacuacugcgcccgccggcgcgggcagcggcugcuggccuacuucgacuacuggggccaggggucccucgucaccgugagcuccgccagcacgaagggc

SEQ ID NO: 11899 - RNA, 375 nt, Artificial Sequence
  derived and/or modified sequence opt1 from anti-HIV_Chain
caggugcagcugcaggagagcggccccgggccggucaagcccuccgagacccucagccugaccugcacgguguccggcgggagcaugaucuccuacuacuggagcuggauccgccagccgcccggcaaggggcuggaguggaucggcuacaucuucaccaacggccggaccaccuacucccccagccuccgcucccgggugacgaucagccuggacaccuccaccaaccacuucagccugcgccucaaguccgucaccgccgccgacacggcgaucuacuacugcgcccggcuggacggggaggccuuccgcuacuaccuggaccucuggggccaggggaaccuggugaccgugagcuccgccagcaccaagggc

SEQ ID NO: 11900 - RNA, 375 nt, Artificial Sequence
  derived and/or modified sequence opt1 from anti-HIV_Chain
caggugcagcugguccagagcggcgccgaggugaagaagcccggggccuccgugaaggucagcugcaagccguccagcaacaccuucaccucccacuacauccacugggugcgccaggcgcccggccaggggcucgaguggaugggcaugaucaaccccgggggcagcacgcgguacgcccccaaguuccagggccgcgugacccugacccgggacaccuccacgcgcaccgucuacauggagcugagcucccuccggagcgaggacaccgccguguacuacugcgcccgcccgcaguacaaccuggggcgggacccccuggacguguggggccucgggaccauggucacgguguccagcgccuccaccaagggc

SEQ ID NO: 11901 - RNA, 375 nt, Artificial Sequence
  derived and/or modified sequence opt1 from anti-HIV_Chain
caggugcagcugcagcaguggggcgccgggcuccugaagcccagcgagacccugucccugaccugcgccgucuacggcgggagcuucuccggcuacuacuggagcuggauccgccagccgcccgggaagggccuggaguggaucggcgagaucaaccacuccgggagcacgaacuacaaccccucccucaagagccgggugaccaucuccguggacaccagcaagaaccaguucucccucaagcugagcuccgucaccgcggccgacacggccguguacuacugcgcccgccugcccaucggcagcgggugguacggccgggacuacugggggcagggcacccucgugaccgucuccagcgccuccaccaagggc

SEQ ID NO: 11902 - RNA, 375 nt, Artificial Sequence
  derived and/or modified sequence opt1 from anti-HIV_Chain
caggugcagcugguccagagcggcgccgaggugaagaagcccggggccuccgugaaggucagcugcaaggcguccggcaacaccuucaccagcuacgggaucacgugggugcgccaggccccgggccaggggcucgaguggaugggcuggaucuccgccuacaacggcaacaccaacuacgcccagaagcugcaggaccggcugaccaugaccacggacaccagcaccuccaccgccuacauggagcuccgcagccugcgguccgacgacacggcgguguacuacugcgccuucagccgccacuacggguccggcaacuacgacuacugggggcagggcacccuggucaccgugagcuccgccagcaccaagggg

SEQ ID NO: 11903 - RNA, 375 nt, Artificial Sequence
  derived and/or modified sequence opt1 from anti-HIV_Chain
caguuccgccuggugcagagcggccccgaggucaagaacccgggguccagcgugaccguguccugcaaggccagcggcgggaccuucuccggccucgggaucaacuggguccggcaggcccccggccagggccuggaguggcugggggacaucaagacgauguacggcaccaccaacuacgcgcccaaguuccaggggcgcgugaccaucacggccgacgagagcaccuccaccagcuacauggagcucuccggccugcggagcgaggacaccgccguguucuacugcguccgcgagcuguucgggcaccaccccgccuucggcguguggggccaggggacguccgugaucgucagcuccgccagcaccaagggc

SEQ ID NO: 11904 - RNA, 375 nt, Artificial Sequence
  derived and/or modified sequence opt1 from anti-HIV_Chain
cgcgugcagcugguccagagcggcgccgaggugaagaagcccggguccagcgugaccgucuccugcaaggccagcggcggguccuucagcuccuacgcgaucagcugggugcggcaggccccgggccaggggcucgagugggugggcggcgucaaggugauguucgggaccgugcacuacucccagaagguccagggccgcgugacgaucaccgccgacgacagcaccgggaccuccuaccuggagcugagcggccuccgguccgccgacacggccguguacuacugcgcgcgcaacgccggggccuacuucuaccccuucgacaucuggggccagggcacccugaucaucgucagcuccgccagcaccaagggg

SEQ ID NO: 11905 - RNA, 375 nt, Artificial Sequence
  derived and/or modified sequence opt1 from anti-HIV_Chain
caggugcagcugcaggagagcggccccgggcucgucaagcccuccgagacccugagccugaccugcacgguguccggcgggagcaucuccagccgcuccuacuacuggggcuggauccggcagccgcccgggaagggccucgagugggugggcagcaucuacuacaccggguccaccuacuacagccccucccucaagagccgcgucaccaucuccguggacacgagccagaaccaguucucccugaagcugaacagcgugaccgccgccgacaccgcggucuacuacugcgcccggcagaagggcuccgggaccagccugcuguacuggggccaggggacgcucgugaccguguccagcgccagcaccaagggc

SEQ ID NO: 11906 - RNA, 375 nt, Artificial Sequence
  derived and/or modified sequence opt1 from anti-HIV_Chain
caggugcagcugguccagagcggcaccgaggugaagaagcccggguccagcgugaaggucuccugcaaggccagcggcgggaccuucuccgacagcgacaucgccugggugcgccaggcgccgggccaggggcucgaguggaugggcggcaucacgcccauguucgacauggccaaguccgcccagaaguuccgggggcgccugaucaucaccgccgacaagagcaccggcaccgccuacauggagcuguccagccuccgguacgaggacgcggccguguacuucugcgcccgcuccagcgggaacuucgaguucgccuucgagaucuggggccaggggacgaagaucaucgucucccuggcgagcaccaagggc

SEQ ID NO: 11907 - RNA, 375 nt, Artificial Sequence
  derived and/or modified sequence opt1 from anti-HIV_Chain
gugguccagcuggugcagagcggcaccgaggugaagaagcccggguccagcgucaagguguccugcaaggccagcggcgggaccuucuccggcagcgacaucuccugggugcgccaggccccggggcagggccucgaguggaugggcgggaucauccccauguucgacaucgaggaccacgcgcagaaguuccggggccgccugacgaucaccgccgacaagagcaccggggccgccuacauggagcuguccagccuccgguccgaggacgccgcggucuacuacugcgcccgcagcuccggcaacuacgacuucgccuucgacaucugggggcagggcacccggcugaucgugagcuccgccagcacgaagggc

SEQ ID NO: 11908 - RNA, 375 nt, Artificial Sequence
  derived and/or modified sequence opt1 from anti-HIV_Chain
gugguccagcugguggagagcggcaccgaggugaagaagcccggguccagcgucaagguguccugcaaggccagcggcgggaccuucuccggcagcgacaucuccugggugcgccaggccccggggcagggccucgaguggaugggcgggaucauccccauguucgacaucgagaaccacgcggagaaguuccggggccgccugacgaucaccgccgucaagagcaccggggccgccuacauggagcuguccagccuccgguccgaggacgccgcgguguacuacugcgcccgcagcuccggcaacuacgacuucgccuacgacaucugggggcagggcacccgggugaucgucagcuccgccagcacgaagggc

SEQ ID NO: 11909 - RNA, 378 nt, Artificial Sequence
  derived and/or modified sequence opt1 from anti-HIV_Chain
caggugcagcugguccagagcggcuccgccaugaagaagcccggggccagcgugcgcguguccugcuggaccagcgaggacaucuucgacaccacggagcucauccacuggguccggcaggcgccgggccaggggcuggaguggaucggcugggugaaggccguguccggggccgucaacuacggcagccuggacuuccgccaccgggugucccucacccgcgaccgggaccugagcaccgcccacauggacauccgcggccugacccaggacgacacggccaccuacuucugcgcgcggcagaaguucgcccgcggggaccagggcugguucuucgaccucugggggcggggcacccugaucguggucuccagcgcc

SEQ ID NO: 11910 - RNA, 378 nt, Artificial Sequence
  derived and/or modified sequence opt1 from anti-HIV_Chain
caggugcagcugcaggagagcggccccgggcucgucaagccguccgagacccugagccugaccugcacgguguccggcgggagcaucuccaaccacuacuggagcuggauccgccagccgcccggcaaggggcucgaguggaucggcuacaucuaccacuccggcaacaucaacuacaagagcucccucaagagccgggccaccaucuccaucgacaccagcaacaaccaguucucccugaagcugagcuccgugaucgccgcggacaccgccgucuacuacugcgcccgcaacuucgggcccggcagccccaacuacgggauggacguguggggccaggggacgaccgugaccgucuccagcgccuccaccaagggc

SEQ ID NO: 11911 - RNA, 378 nt, Artificial Sequence
  derived and/or modified sequence opt1 from anti-HIV_Chain
caggugcagcugguccagagcggcgggggcguggugcagcccgggcgcucccuccggcugagcugcgccgccuccggcuucaccuucagccaccacgggauccacuggguccgccaggcgccgggcgagggccuggaguggguggccgugaucuccgaggacgggaccaacauccacuacgaggacagcguccggggccgcuucacgaucucccgggacaacagcaagaacaccguggaccuccagaugaacucccugcgcgccgaggacaccgccguguacuacugcgccagccugaucuccaugcgggacggggacgcguucgaccucuggggccaggggacccgcgucacggugagcuccgccagcaccaagggc

SEQ ID NO: 11912 - RNA, 378 nt, Artificial Sequence
  derived and/or modified sequence opt1 from anti-HIV_Chain
caggugcagcuggucgagagcggcgggggccucgggcagcccggcgggucccugcgccugagcugcgccgccuccggcuucaccuuccggaacuacgcgaugagcugggugcgccaggccgccggcaaggggcucgaguggguguccggcgucagcgggggcggggacaccacguacuacggcgacuccgugaagggccgguucaccaucagccgcgacaacuccaagaacacccuguaccugcagaugaacaaccuccgggccgaggacaccgccguguacuacugcgcgaaggacaagggggucuggggcagcuccgacuucgacuacugggggcagggcacgcuggugaccgugagcuccgccagcaccaagggc

SEQ ID NO: 11913 - RNA, 378 nt, Artificial Sequence
  derived and/or modified sequence opt1 from anti-HIV_Chain
gaggugcagcuggucgagagcggcgggggcguggugcagcccgggcgcucccuccggcugagcugcgccgccuccggcuucaccuucagccaccacgggauccacuggguccgccaggcgccgggcgagggccuggaguggguggccgugaucuccgaggacgggaccaacauccacuacgaggacagcguccggggccgcuucacgaucucccgggacaacagcaagaacaccguggaccuccagaugaacucccugcgcgccgaggacaccgccguguacuacugcgccagccugaucuccaugcgggacggggacgcguucgaccucuggggccaggggacccgcgucacggugagcuccgccagcaccaagggc

SEQ ID NO: 11914 - RNA, 378 nt, Artificial Sequence
  derived and/or modified sequence opt1 from anti-HIV_Chain
cgcggccccgugacccuggccgucagccucggggagcgggccaccaucacgugcaaguccagccaguccgugcuggugcacagcaacaacaagaacuaccuguccugguaccagcagaagcccggccagccgcccaagcuccugaucuacugggcgagcacccgcgaguccgggguccccgagcgguucagcggcuccgggagcggcaccgacuucacccuguccaucagcucccuccaggccgaggacguggccguguacuacugccaccaguacuucagcacgccccgcaccuucggccaggggaccaaggucgagaucaagggcaccguggccgcccccuccguguucaucuucccgcccagcgacgagcagcug

SEQ ID NO: 11915 - RNA, 378 nt, Artificial Sequence
  derived and/or modified sequence opt1 from anti-HIV_Chain
agcgagaucgugaugacccagucccccgccacccugagcaugucccccggcgagcgcgccacgcucagcugccgggcgucccugagcgucaacaccaaccuggccugguaccagcagaagcccgggcaggcgccccgccuccugaucuacggcgccuccacccgggccaccgggauccccgcccgcuucagcggcuccgggagcggcacggaguucacccugaccaucuccagccuccaguccgaggacuucgcccuguacuacugccagcaguacaaccacuggccgcagaccuucggccaggggacgaagguggagaucaagcggaccguggccgcccccagcgucuucaucuucccgcccuccgacgagcagaag

SEQ ID NO: 11916 - RNA, 378 nt, Artificial Sequence
  derived and/or modified sequence opt1 from anti-HIV_Chain
agcgagaucgugcugacccagucccccgccacccucagccugucccccggcgagcgcgccacgcugagcugccgggcgucccagagcaucaacaacuaccucgccugguaccagcagaagcccgggcaggcgccccgccugcugaucuacgacgccuccaaccgggccaccggcauccccgcccgcuucagcgggggcggguccggcaccgacuucacccucacgaucagcucccuggagccggaggacuucgccgucuacuacugccagcagcgggccaacuggcgccugcucaccuucggcgggggcaccaagguggagaucaagcggaccguggccgcgcccagcgucuucaucuucccgcccuccgacgagcag

SEQ ID NO: 11917 - RNA, 378 nt, Artificial Sequence
  derived and/or modified sequence opt1 from anti-HIV_Chain
caggugcagcugguccagagcggcggggccgugaagaagcccggcgccuccgugaaggucagcugcgagaccuacggguacaccuucacggaccacuucaugcacugguggcgccaggcgccgggccaggggcucgaguggaugggcuggaucaaccccuacuccagcgccguguccuacagcccccgguaccagggccgcgugaccaugacccgggacaccuuccuggagacggucuacauggagcugcgcgggcucaaguucgacgacaccgccaucuacuacugcgccacccccaaguccggccgggacuacuggagcuucgaccugugggggcagggcacccuggugacgguguccagcgccuccaccaagggg

SEQ ID NO: 11918 - RNA, 378 nt, Artificial Sequence
  derived and/or modified sequence opt1 from anti-HIV_Chain
agccaggugcagcuggucgaguccggccccgggcucgugaagccgagcgagacccugucccugaccugcagcguguccaacggcagcaucuccagcgggggcuacuacugguccuggcuccgccaguuccccgggaagggccuggaguggaucggcagcauccacuacacggggcggaccauguacaaccccucccugaugggccgccccgcccucagcauggacaccuccaacaaccaguucagccugaagcuguccagcgucaccgccgcggacacggcccucuacuucugcgcccgggaccugcaguggaucuucgugguggacccgugggggcagggcacccuggucaccguguccagcgccuccaccaagggg

SEQ ID NO: 11919 - RNA, 378 nt, Artificial Sequence
  derived and/or modified sequence opt1 from anti-HIV_Chain
agcgugguccagcugguggaguccggccccgggcucgugaagccgagcgagacccugucccugaccugcagcgucuccaacggcagcaucuccagcgggggcuacuacugguccuggcuccgccaguuccccgggaagggccuggaguggaucggcagcauccacuacacggggcggaccauguacaaccccucccugaugggccgccccgcccucagcauggacaccuccaacaaccaguucagccugaagcugcgguccgugaccgccgcggacacggcccucuacuucugcgcccgcgaccugcaguggaucuucguggucgacccgugggggcagggcacccuggugaccgugagcuccgccagcaccaagggg

SEQ ID NO: 11920 - RNA, 378 nt, Artificial Sequence
  derived and/or modified sequence opt1 from anti-HIV_Chain
agcggcgggcgccuggugcagcccggcgggucccuccggcugagcugcuccgccagcggcuucacccuguccaacagcgccauguccuggguccgccaggcgccggggaagggccucgagugggugagcuccauccugagcuccggcguggggaccuucuacgccgacagcgucaagggccgguucacggugucccgcgacaacagccggaacacccuguaccuccagaugaagucccugcgcgccgaggacaccgcccuguacuacugcgccaaggugcagauccagcagcucaacuucggggucaucaccgacgcgggccuggacgugugggggaagggcacgacccugaucgugagcuccgccagcaccaagggc

SEQ ID NO: 11921 - RNA, 378 nt, Artificial Sequence
  derived and/or modified sequence opt1 from anti-HIV_Chain
caggugcagcugguccagagcggcgccgccgugaagaagcccggggcguccgugaaggucagcugcgaggccuacggcuacaaguucaccgaccacuucaugcacugguggcgccaggccccggggcagggccucgaguggaugggguggaucaaccccuacaccuccgccgugaacuacagccccaaguaccagggccgggugacgaugacccgcgacaccuuccuggagaccgucuacauggagcugcggggccuccgcguggacgacacggccaucuacuacugcgcgacccccaaguccgggcgggacuacuggagcuucgaccuguggggccaggggacccuggugaccgucuccagcgccuccacgaagggc

SEQ ID NO: 11922 - RNA, 378 nt, Artificial Sequence
  derived and/or modified sequence opt1 from anti-HIV_Chain
caggugcagcugguccagagcggcgccgccgugaagaagcccggggcguccgugaaggucagcugcgagaccuacggcuacaaguucaccgaccacuucaugcacugguggcgccaggccccggggcagggccucgaguggaugggguggaucaaccccuacuccagcgccguguccuacagcccccgguaccagggccgcgugacgaugacccgggacaccuuccuggagaccgucuacauggagcugcgcggccuccgguucgacgacacggccaucuacuacugcgccacccccaaguccgggcgcgacuacuggagcuucgaccuguggggccaggggacccuggugaccguguccagcgcguccacgaagggc

SEQ ID NO: 11923 - RNA, 378 nt, Artificial Sequence
  derived and/or modified sequence opt1 from anti-HIV_Chain
caggugcagcugguccagagcggcgccgccgugaagaagcccggggcguccgugaaggucagcugcgagaccuacggcuacaccuucacggaccacuucaugcacugguggcgccaggccccggggcagggccucgaguggaugggguggaucaaccccuacuccagcgccguguccuacagcccccgguaccagggccgcgugaccaugacccgggacaccuuccuggagacggucuacauggagcugcgcggccucaaguucgacgacaccgccaucuacuacugcgccacccccaaguccgggcgggacuacuggagcuucgaccuguggggccaggggacccuggugacgguguccagcgcguccaccaagggc

SEQ ID NO: 11924 - RNA, 378 nt, Artificial Sequence
  derived and/or modified sequence opt1 from anti-HIV_Chain
caggugcagcugguccagagcggcgccgaggugaagaagcccggguccagcgugaaggucuccugcaagaccagcggcgugcgcuucuccagcaacgccaucuccugggugcggcaggcgccggggcagggccucgaguggauggggcgcaccacgcccaugcugggcggcgccaaccacgcccccagcuucaaggggcgggucaccaucuccgccgacgagagcacccgcaccguguacauggagauguccagccugcgguacgaggacacggccguguacuacugcgcguccggccgccgggaggggcucaacuuccugcuggacuacuggggccaggggacccucgucaccgugagcuccgccagcaccaagggc

SEQ ID NO: 11925 - RNA, 378 nt, Artificial Sequence
  derived and/or modified sequence opt1 from anti-HIV_Chain
caggugcagcugcaggagagcggccccgggcucgucaagcccuccgagacccugagccugaccugcacgguguccggcgggagcaucuccaccuacuacuggagcuggauccgccagccgcccggcaaggggcucgaguggaucggcuacaucuccuacagcggcuccaccaacuacaaccccagccugaagucccgggugaccaucagcgucgacacguccaagaaccaguucagccugaagcucuccagcgugaccgccgccgacaccgcgguguacuacugcgcccgccacaaguccguccugcugugguuccgggagcucgacuacugggggcagggcacccuggugacggugagcuccgccagcaccaagggg

SEQ ID NO: 11926 - RNA, 378 nt, Artificial Sequence
  derived and/or modified sequence opt1 from anti-HIV_Chain
caggugcagcugguccagagcggcgccgaggugaagaagcccggggccgcggugaagaucuccugcaaggccagccgcuucaccuucuccagcuacuacauccacuggguccggcaggccccgggccaggggcucgaguggaugggcaucaucaaccccuccgggggcagcaccuccaacgcccagaaguuccaggaccgcgugacgcugacccgggacaugagcaccggcaccguguacauggagcugucccgccucacgagcgaggacaccgccgucuacuacugcgcgacccccgagcccuccagcaucguggccccgcuguacuacugggggcagggcacccuggugacggucuccagcgccuccaccaagggg

SEQ ID NO: 11927 - RNA, 378 nt, Artificial Sequence
  derived and/or modified sequence opt1 from anti-HIV_Chain
caggugcagcugguccagagcggcgccgagaugaagaagcccggggccuccgugaaggugagcugcaaggcguccggccacaccuucaccaacuacuacaugcacuggguccgccaggccccggggcagggccucgaguggauggggaugaucaaccccacgggcgacagcacccgguacgcccagcgcuuccagggccgggugaccaugacccgcgacacguccacccggaccguguacauggagcugagcucccugcgcagcgacgacaccgccgucuacuacugcgcccgggcgcaccacgacuucuggcgcgcccccguggacgugugggggaagggcacgaccgucaccguguccagcgccuccaccaagggg

SEQ ID NO: 11928 - RNA, 378 nt, Artificial Sequence
  derived and/or modified sequence opt1 from anti-HIV_Chain
caggugguccugauccagagcggcgccgaggugaagcgccccggguccagcgugaaggucuccugcaaggccagcggcggguccuucccgaucaccugggugcggcaggcgcccggccacgggcucgaguggaugggcggcaucaaccccuucuucgggaccacgaacuacgcccagaaguuccagggccgcgugagcaucaccgccgacgaguccaccagcaccacguaccugcaccuguccgaccuccggagcgaggacaccgccgucuacuucugcgcccgcgagaaccgggagaaguggcuggugcugcgcuccugguucgcgcccugggggcagggcacccucgugaccgucagcuccgccagcacgaagggg

SEQ ID NO: 11929 - RNA, 378 nt, Artificial Sequence
  derived and/or modified sequence opt1 from anti-HIV_Chain
agccagcagcuggugcaguccggcgcccaggucaagaagcccggggccagcgugcgcguguccugccaggcgagcggcuacaccuucaccaaccacuuccugcacugguggcggcaggccccgcgccaggggcuggaguggaugggcuggaucaaccccguccacgggggccggaacuacgcccgccgguuccagggccgcaucaacuucgggcgggacguguaccaggagacggccuacauggagcuguccggccuccgcaacgacgacaccgccaccuacuucugcgcgcgcgggggcggggacggccggaacuggcaccuccaccccuggggccaggggacccuggugaucgucagcgccgccuccacgaagggc

SEQ ID NO: 11930 - RNA, 378 nt, Artificial Sequence
  derived and/or modified sequence opt1 from anti-HIV_Chain
gaggugcaggucguggagagcggcgggggccuggugcagcccgggggcucccuccgccugagcugcgucgccuccggguucaccuucagcgaguacuggauguccugggugcggcaggccccgggcaagggccuggaguggguggcgaccaucaagcgcgacgggagcgaggaguccuacgucgacagcgugaagggccgguucacgaucucccgcgacaacgccaagaacagccucuaccugcagaugaacucccugcgggccgaggacaccgccguguacuacugcgcccgcguccgggaccccaacuacaaccuccacuucgacagcugggggcagggcacccuggugaccguguccagcgcguccacgaagggg

SEQ ID NO: 11931 - RNA, 378 nt, Artificial Sequence
  derived and/or modified sequence opt1 from anti-HIV_Chain
cuggugcagcucgucgagagcggcgggggcguggugcagcccgggaagucccugcgccugagcugcgccaccuccggcuucaccuucagcacguacgggaugcacuggguccggcaggccccgggcaagggccucgaguggguggcggugaucugguacgacggguccuacaaguacuacgccgacagcgucaagggccgcuucaccaucucccgggacaacagcaagaacacccuguuccugcagaugaacucccuccgcgccgaggacaccgccauguacuacugcgggcgggagauggccgugggcgggacgaaggcgcuggaccacuggggccagggcacccuggugaccgucagcuccgccagcaccaagggg

SEQ ID NO: 11932 - RNA, 378 nt, Artificial Sequence
  derived and/or modified sequence opt1 from anti-HIV_Chain
gaguuccagcuggugcagagcggcgggggccucgucaagcccgggggcucccugcgccugagcugcaccggguccaccuucagcuucuccagcgacgacaugaacugggugcggcaggcccccggcaagggccucgaguggguguccagcauguccgacagcgggucccacaucuacuacgccgacuucgucaagggccgcuucacgaucagccgggacaacgcgaagaagucccuguaccugcagaugaacagccuccgcgccgaggacaccgccguguacuacugcgcccagucccggccgccccagcgccuguacgggauggacguguggggccaggggaccaccgucacggugagcuccgccagcaccaagggc

SEQ ID NO: 11933 - RNA, 381 nt, Artificial Sequence
  derived and/or modified sequence opt1 from anti-HIV_Chain
gaggugcagcuggucgagagcggcgggggcguggugcagcccgggggcucccuccgccugagcugcgccgccuccggguucauguucaagaacuacgcgaugcacuggguccggcagccgcccggcaagggccuggaguggguggccgugaucugguacgggggccgcgaccagaacuacgccgacagcgucaaggggcgguucaccaucucccgcgacgacagcgacaacacccucuaccugcagaugaacucccugcgggccggcgacacggccguguacuucugcgcgcgcaacagccagguggggcggcucaugcccgccgccggcgucuggggccaggggacccuggugaccguguccagcgccuccaccaagggc

SEQ ID NO: 11934 - RNA, 381 nt, Artificial Sequence
  derived and/or modified sequence opt1 from anti-HIV_Chain
cagggccaccuggugcagagcgggggcggggucaagaagcucggcaccuccgugaccaucagcugccuggccuccgaguacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacg

SEQ ID NO: 11935 - RNA, 381 nt, Artificial Sequence
  derived and/or modified sequence opt1 from anti-HIV_Chain
caggugcagcugcucgagagcggcgggggccugguccagcgcgggggcucccugcggcucagcugcaccgccuccggguucguguucaacaacuacuggaugaccugggugcgccaggcccccggcaacggccuggagugggucgcgaacaucgaccaggacgggagcgagaagcacuaccuggacuccgugaagggccgguucacgaucagccgcgacaacgccaagaacucccucuaccugcagaugaacagccugcgggccgaggacaccgccaucuacuacugcgcccgcgugcgguucaaggucaccgcguggcaccgcuucgacuccugggggcagggcgaccucgugaccgugagcuccacgagcaccaagggg

SEQ ID NO: 11936 - RNA, 381 nt, Artificial Sequence
  derived and/or modified sequence opt1 from anti-HIV_Chain
cagagcgcccugacccagcccccguccgccagcggcacccccgggcagcgcgugacgaucuccugcagcggcuccuaccacaacaucgggagcaacgcggucaacugguaccagcagcuccccggcaccgcccccaagcugcugaucuacuccaacgaccagcggccgagcggggugcccgaccgcuucuccggcagcaaguccggcaccagcgccucccucgccaucagcgggcugcaguccgaggacgaggccgacuacuacugcgcggccugggacgacagccugcacguguucggcaccgggacgaaggucaccgugcucggccagcccaaggccaaccccaccgugacccuguucccgcccuccagcgaggagcug

SEQ ID NO: 11937 - RNA, 381 nt, Artificial Sequence
  derived and/or modified sequence opt1 from anti-HIV_Chain
cagagcgugcugacccagguccucuccgugagcggcacccccgggcagcgcgugaucaucuccugcagcggcacguccagcaacgucgggggcaaccugguguccugguaccagcaccucccgggggccgcgccccggcugcugauccaccgcgacgaccagcggcccagcggcgugcccgaccgcuucuccggcagcaaguccgggaacagcgccucccuggucaucagcggccuccgguccgacgacgaggccgacuacuucugcgccgccuacgacagcaccuucucccugccgguguucgggggcgggacccgccugaccgugcucagccagcccaaggccgcgcccuccgucacgcuguucccgcccagcagcgag

SEQ ID NO: 11938 - RNA, 381 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaaccccugccaguuccagggccgggugagccugacgcgccacgccuccugggacuucgacaccuucagcuucuacauggaccucaaggcccugcgguccgacgacaccgcgguguacuucugcgcccgccagcggagcgacuacugggacuucgacgucuggggguccggcacccaggugacggugagcuccgccagcaccaag

SEQ ID NO: 11939 - RNA, 381 nt, Artificial Sequence
  derived and/or modified sequence opt1 from anti-HIV_Chain
caggugcagcugguccagagcggcggggaggugcgcaagcccggcuccagcgugaaggucccgugcaagaucuccgggaacgccuucagcaacuacggcgugaacugggugcggcaggcccccgggcagggccucgagugggucggccgcaucauccccgugaucgggguggcgcagcacgcccccaaguuccagggccgggucaccaucaccgccgacaaguccacgaccaccgccuaccuggagcugagcucccuccgcagcgacgacaccgccguguacuucugcgcgaaggaccacggggacccgcggacgggcuacuacuucgacuacugggggcagggcgcccuggugaccgucuccagcgccuccaccaagggc

SEQ ID NO: 11940 - RNA, 381 nt, Artificial Sequence
  derived and/or modified sequence opt1 from anti-HIV_Chain
caggugcagcugggccagagcgggaccgaggucaagaagcccggcuucuccgugaaggugagcugcaaggccuccgggggcagcuccaccgccuacggguacagcuggguccgccaggcgccgggccagggcuucgaguggauggggcggaucauccccuucuacggcaucaucacguacgcccccaaguuccaggggcgcgugaccaucaccgccgaccgguccaccagcacgguguacauggagcucaccucccugaccuucgccgacaccgcccuguucuucugcgcgcgcgacuucggcgacccccggaacggguacuacuucgacagcugggaccagggccucuggcugacggucuccagcgccuccaccaagggc

SEQ ID NO: 11941 - RNA, 381 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggaccuucuccaacuacgcgaucagcugggugcgccaggccccgggccaggggcucgaguggaugggcggcaucauccccaucuucgaggccgccuccuacgcccagaaguuccaggaccggcugaccaucacgaccgacgagagcaccaccacggcguacauggaccuguccagccuccgcuccgaggacaccgccaucuacuacugcgcccgggcccagggggacauccugaccgagggcuacuucgacuacugggggcagggcacccuggugacggucagcuccgcgagcaccaagggg

SEQ ID NO: 11942 - RNA, 381 nt, Artificial Sequence
  derived and/or modified sequence opt1 from anti-HIV_Chain
caggugcagcugcaggagagcggccccgggcucgucaagccguccgagacccugagccugaccugcacgguguccggcgggagcaucuccagcgccggcuacuacugguccuggauccgccagcaccccgagaaggggcucgaguucaucggcuacaucuacuaccugggcaccaccuacuacaaccccagccugaagucccgggugagcaucuccaucgacaccagcaacaaccaguucucccucgagcugagcuccgucagcgccgcggacacggccaucuacuacugcgcccgcgacuacaccgccuccgggcggcacuucuucgacuacuggggccaggggacccuggugaccgugagcuccgccagcacgaagggc

SEQ ID NO: 11943 - RNA, 381 nt, Artificial Sequence
  derived and/or modified sequence opt1 from anti-HIV_Chain
caggugcagcugguccagagcggcgccgaggugaagaagcccggggccuccgugaaggucagcugcaaggcgccgggcuacaccuucaucgggcacuacaugcacuggauccgccaggcccccggccaggggcucgaguggaugggcuggaucaaccccaacuccggcgacaccaacuacgcccagacguuccaggggcgggugaccaugacccgcgacaccagcaucuccacggccuacauggagcugacccggcugcgcagcgacgacaccgccguguacuacugcgcgcgggaccuccgccccaugcggggcaacugggccaugcacgucuggggcgaggggaccacggugaccguguccagcgccuccaccaagggg

SEQ ID NO: 11944 - RNA, 381 nt, Artificial Sequence
  derived and/or modified sequence opt1 from anti-HIV_Chain
caggugcagcugcaggagagcggccccgggcucgucaagccguccgagacccugagccugaccugcacgguguucggcgccuccauccgcagcuucuacuggcacuggauccggcagucccccgggaagggccucgaguggcuggggagcguguucgacaacggccugaccaccuacaaccccucccucaagaaccgccugagcaucuccgaggaccccagccggaaccagaucucccugaaccuccgcagcaugaccgccgcggacacggccgucuacuacugcgcccgggccgacuacgaccugcugaccuccagcuaccacuucgacuccuggggccaggggacccucgugaccgugagcuccgccagcacgaagggc

SEQ ID NO: 11945 - RNA, 381 nt, Artificial Sequence
  derived and/or modified sequence opt1 from anti-HIV_Chain
agccagcagcuggugcaguccggcacccaggucaagaagcccggggccagcgugcgcguguccugccaggccagcggcuacaccuucacggacuacguccugcacugguggcggcaggcgccggggcagggccuggaguggaugggguggaucaagcccguguacggcgcccgcaacuacgcccaccgguuccagggccgcaucaacuucgaccgggacguguaccgcgagaucgccuacauggaccuguccgggcuccggagcgacgacaccgccgucuacuucugcgcgcgcgacggcuccggggacgccaccagcuggcaccuccaccccuggggccaggggacccuggugaucguguccagcgccuccacgaagggc

SEQ ID NO: 11946 - RNA, 381 nt, Artificial Sequence
  derived and/or modified sequence opt1 from anti-HIV_Chain
agccagcagcuggugcaguccggcacccaggucaagaagcccggggccagcgugcgcguguccugccaggccagcggcuacaccuucacgaacuacauccuccacugguggcggcaggcgccggggcgcggccuggaguggauggggcugaucaagcccgucuacggcgccgugaacuacgcccggcaguuccagggccgcauccagcucacccgggacaucuaccgcgagaucgccuuccuggaccuguccgggcuccggcccgacgacaccgccguguacuacugcgcgcgcgacgagagcggcuacgaccugaacuggcaccuggacuccugggggcagggcacccaggucaucgugagccccgccuccacgaagggg

SEQ ID NO: 11947 - RNA, 381 nt, Artificial Sequence
  derived and/or modified sequence opt1 from anti-HIV_Chain
agccagcagcuggugcaguccggcgcccaggucaagaagcccggggccagccuccgcguguccugccaggcgagcggcuacaccuucaugaacuaccugcugcacugguggcggcaggccccggggcagggccucgaguggaugggguggaucaaccccguguacggcgccgucaacuacgcccaccgcuuccagggccggcugaccuucucccgcgacguguaccgggagaucgccuacauggaccugaacgggcuccgcagcgacgacacggcgguguacuucugcgcccgggacggcuccggggacgaccgcaacuggcaccuggaccccuggggccaggggacccuggucaucgugagcuccgccagcaccaagggc

SEQ ID NO: 11948 - RNA, 381 nt, Artificial Sequence
  derived and/or modified sequence opt1 from anti-HIV_Chain
agccagcagcuggugcaguccggcacccaggucaagaagcccggggccagcgugcgcaucuccugccaggccagcggcuacaccuucacggacuacgugcuccacugguggcggcaggcgccggggcagggccuggaguggaugggguggaucaagcccgucuacggcgcccgcaacuacgcccggcgcuuccagggccggaucaacuucgaccgcgacaucuaccgggagaucgccuuccuggaccucuccgggcugcgcagcgacgacaccgcccgguacuucugcgcgcgcgacggcuccggggacgacaccagcuggcaccuccaccccuggggccaggggacccuggugaucguguccgccgccagcacgaagggc

SEQ ID NO: 11949 - RNA, 381 nt, Artificial Sequence
  derived and/or modified sequence opt1 from anti-HIV_Chain
agccagcagcuggugcaguccggcacccaggucaagaagaccggggccagcgugcgcguguccugccaggccagcggcuacgacuucacgaaguaccucauccacugguggcggcaggcgcccgggcagggccuggaguggaugggguggaugaagccggucuacggcgccaccaacuacgcccaccgcuuccagggccggaucuccuucacccgcgacaucuaccgggagaucgccuucauggaccugaacgggcuccgcagcgacgacaccgccguguacuucugcgcgcgggacggcgggggcgacgaccgcacguggcugcuggacgccugggggcagggcacccucgugaucgucuccagcgccuccaccaagggc

SEQ ID NO: 11950 - RNA, 381 nt, Artificial Sequence
  derived and/or modified sequence opt1 from anti-HIV_Chain
agccagcagcuggugcaguccggcacccaggucaagaagcccggggccagcgugcgcguguccugccaggccagcggcuacaccuucaugaacuacaucauccacugguggcggcaggcgccggggcagcgccucgaguggaugggcuggaucaaccccgucuucggggcccggaacuacgcccaccgcuuccagggccggaucaacuucgaccgcgacaucaaccgggagacguuccagauggaccugaccggccugcgcuccgacgacaccgccguguacuacugcgcccgggacgggagcggcgacgcgcgcgacuggcaccuccaccccugggggcagggcacccuggugaucgucuccagcgccuccacgaagggg

SEQ ID NO: 11951 - RNA, 381 nt, Artificial Sequence
  derived and/or modified sequence opt1 from anti-HIV_Chain
agccagcaccuggugcaguccggcacccaggucaagaagcccggggccagcgugcgcguguccugccaggccagcggcuacaccuucacgaacuacauccugcacugguggcggcaggcgccggggcagggccuggaguggauggggcugaucaagcccgucuucggcgccgugaacuacgcccgccaguuccagggccggauccagcucacccgcgacaucaaccgggagaucgccuuccuggaccuguccgggcuccgcagcgacgacaccgccguguacuacugcgcgcgggacgaguccggcgacgaccugaaguggcaccuccaccccugggggcagggcacccaggucaucgugagccccgccuccacgaagggg

SEQ ID NO: 11952 - RNA, 381 nt, Artificial Sequence
  derived and/or modified sequence opt1 from anti-HIV_Chain
agccagcagcuggugcaguccggcacccaggucaagaagcccggggccagcgugcgcguguccugccaggccagcggcuacaccuucaugaacuacaucauccacugguggcggcaggcgccggggcagcgccucgaguggaugggcuggaucaaccccgucuucggggcccggaacuacgcccaccgcuuccagggccggaucaacuucgaccgcgacaucaaccgggagacguuccagauggagcugaccggccugcgcuccgacgacaccgccguguacuacugcgcccgggacgggagcggcgacgcgcgcgacuggcaccucgaccccugggggcagggcacccuggugaucgucuccagcgccuccacgaagggg

SEQ ID NO: 11953 - RNA, 381 nt, Artificial Sequence
  derived and/or modified sequence opt1 from anti-HIV_Chain
agccagcagcuggugcaguccggcacccaggucaagaagcccggggccagcgugcgcaucuccugccaggccagcggcuacaccuucacggacuacgugcugcacugguggcggcaggcgccggggcagggccuggaguggaugggguggaucaagcccgucuacggcgcccgcaacuacgcccggcgcuuccagggccggaucaacuucgaccgcgacaucuaccgggagaucgccuacauggaccuguccgggcuccgcagcgacgacaccgcccgguacuucugcgcgcgcgacggcuccggggacgacaccagcuggcaccuccaccccuggggccaggggacccuggugaucguguccgccgccagcacgaagggc

SEQ ID NO: 11954 - RNA, 381 nt, Artificial Sequence
  derived and/or modified sequence opt1 from anti-HIV_Chain
agccagcagcuggugcaguccggcacccaggucaagaagcccggggccagcgugcgcaucuccugccaggccagcggcuacuccuucaccgacuacgugcuccacugguaccggcaggcgccggggcagggccuggaguggaugggguggaucaagcccgucuacggcgcccgcaacuacgcccggcgcuuccagggccggaucaacuucgaccgcgacaucuaccgggagaucgccuucauggaccugagcgggcuccgcuccgacgacacggcccuguacuucugcgcgcgggacggcagcggggacgacaccuccugguaccuggaccccuggggccaggggacccucgugaucgugagcgccgccuccaccaagggc

SEQ ID NO: 11955 - RNA, 381 nt, Artificial Sequence
  derived and/or modified sequence opt1 from anti-HIV_Chain
agccagcagcuggugcaguccggcacccaggucaagaagcccggggccagcgugcgcaucuccugccaggccagcggcuacuccuucaccgacuacgugcuccacugguggcggcaggcgccggggcagggccuggaguggaugggguggaucaagcccgucuacggcgcccgcaacuacgcccggcgcuuccagggccggaucaacuucgaccgcgacaucuaccgggagaucgccuucauggaccugagcgggcuccgcuccgacgacacggcccuguacuucugcgcgcgggacggcagcggggacgacaccuccuggcaccuggaccccuggggccaggggacccucgugaucgugagcgccgccuccaccaagggc

SEQ ID NO: 11956 - RNA, 381 nt, Artificial Sequence
  derived and/or modified sequence opt1 from anti-HIV_Chain
agccagcaccuggugcaguccggcacccaggucaagaagcccggggccagcgugcgcguguccugccaggccagcggcuacaccuucacgaacuacauccugcacugguggcggcaggcgccggggcagggccuggaguggauggggcugaucaagcccgucuucggcgccgugaacuacgcccgccaguuccagggccggauccagcucacccgcgacaucuaccgggagaucgccuuccuggaccuguccgggcuccgcagcgacgacaccgccguguacuacugcgcgcgggacgaguccggcgacgaccugaaguggcaccuccaccccugggggcagggcacccaggucaucgugagccccgccuccacgaagggg

SEQ ID NO: 11957 - RNA, 381 nt, Artificial Sequence
  derived and/or modified sequence opt1 from anti-HIV_Chain
caggugcagcuggucgagagcggcgggggcguggugcagcccgggaagucccuccgccugagcugcgccaucuccggcuuccuguucaacaacuacgggggccaguggguccggcaggcccccggcaaggggcucgaguggguggcggccaucagcuacgacggcaacaaccgcuacuacgccgacuccgccaaggggcgguuccugaucagccgcgacacccccaagaacauccuguaccuccagaucuacucccugcggcuggacgacaccgccguguacuacugcgcgcgcgacagcgucuccaagagcuacuccgccccgcccgaguucuggggccaggggacgguggugaccgucagcuccgccagcaccaagggc

SEQ ID NO: 11958 - RNA, 381 nt, Artificial Sequence
  derived and/or modified sequence opt1 from anti-HIV_Chain
caggugcaccuggaggagagcggccccgggcucgucaagaccucccagacccugagccugacgugcuccgugagcuccuacagcaucucccgcagcggcuacuucuggaccuggauccggcagcgcccggggaagggccucgaguggaucggguacaucuacuucaacggccggaccaccuacaaccccucccucaagagccgcaucacgaucucccgggacaccagccacucccaguucagccugacccugaacucccugagcgccgccgacaccgcgguguacuacugcggccgcugccaggacgggcuggccucccggcccaucgacuucuggggccaggggacgcucgucaccgugagcuccgccagcaccaagggc

SEQ ID NO: 11959 - RNA, 381 nt, Artificial Sequence
  derived and/or modified sequence opt1 from anti-HIV_Chain
caggugcagcuggucgagagcggcgggggcguggugcagcccgggcgcucccuccggcugagcugcgccaccuccggcuucaccagcaagaacuacgggguccacugggugcgccaggccccgggcaagggccuggaguggguggcggucaucugguacgacggguccaacaaguucuacgccgacagcgugaagggccgguucacgaucucccgcgaccggagcaagaacaugguguaccuccagaugaacucccugcgcgucgaggacaccgccaucuacuacugcgcccgggacagcguggccuucgugcuggaggggcccaucgacuacuggggccaggggacccucgucaccguguccagcgcguccacgaagggc

SEQ ID NO: 11960 - RNA, 384 nt, Artificial Sequence
  derived and/or modified sequence opt1 from anti-HIV_Chain
caggugcagcugguccagagcggcgggggcgugaagaagcccgggaccuccgccagcuucuccugccgcaccagcgacgacaucuacgacaacgaguucuucgacuccgccuucaugcacugggugcggcucaucccgggccagcgccccgaguggaugggguggaugaacccccggagcggcgcggucaacuacgcccgccagcugcagccccggguguccauguaccgcgaccgggaccugagcacggccuacauggaguucaagucccucaccagcgccgacaccggcaccuacuucugcgcccgcaagaagcgcggggacggcuucaaccuguacuucgaccugugggggcggggcucccaggugaucgucagcuccgcg

SEQ ID NO: 11961 - RNA, 384 nt, Artificial Sequence
  derived and/or modified sequence opt1 from anti-HIV_Chain
cagggccaccuggugcagagcgggggcggggucaagaagcucggcaccuccgugaccaucagcugccuggccuccgaggacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacgagc

SEQ ID NO: 11962 - RNA, 384 nt, Artificial Sequence
  derived and/or modified sequence opt1 from anti-HIV_Chain
cagagcgcccugacccagcccccguccgugagcggcgcccccgggcagcgcgucaccaucuccugcagcggcgggcccuccaacgugggcgggaacuacguguacugguaccggcaguuccccggcacggcgcccaagcuccugauccugcgcgacgaccagcggcccagcggcguccccgaccgcuucuccgccagcaaguccgggaacagcgccucccucgccaucagcggccugcggcccgacgacgaggccuucuacuucugcgcgaccuacgacucccaggggagcuuccgcguguucggcgggggcaccgcccugaccgugcucucccagccgaaggccgcccccagcgucacgcuguacccgcccuccagcgaggag

SEQ ID NO: 11963 - RNA, 384 nt, Artificial Sequence
  derived and/or modified sequence opt1 from anti-HIV_Chain
aacuucaugcugacccagcccccgagcgccuccggcacccccgggcagcgcgugacgaucagcugcuccggcgggggcagcaacaucgggggcaaccucgucuccugguaccagcacuuccccggcgccgcgcccaagcugcugaucuaccggaacgaccagcgcccgagcggggugcccgaccgguucuccggcagcaaguccgggaccagcgccucccucgccaucagcggccugcgcuccgacgacaaggccaccuacuucugcgccgcguacgacagcacccugucccuccggcuguucgggggcggcacgacccugaccgugcucagccagcccaaggccgcccccuccgucacccuguucccgcccagcuccgaggag

SEQ ID NO: 11964 - RNA, 384 nt, Artificial Sequence
  derived and/or modified sequence opt1 from anti-HIV_Chain
aacuucaugcugacccagcccccgagcguguccgccacccccggccagacggucaccaucagcugcuccgggagcggcuccaacgucgggggcaaccacguguacugguaccgccagcuccccggggccgcgcccacccuggugaucagcaagaccgaccaccggcccucccgcgugcccgaccgguucagcggcuccaagagcggcaacuccgccagccuggccaucuccgggcuccgccccgacgacgaggccguguacuucugcgccacguacgacaccggccugagccugcgccucuucgggggcgggacccggcugaccguccugucccagcccaaggcggccccgagcgugacgcaguucccgcccuccagcgaggag

SEQ ID NO: 11965 - RNA, 384 nt, Artificial Sequence
  derived and/or modified sequence opt1 from anti-HIV_Chain
cagagcgcccugacgcagccgcccuccgccagcggcgcgcccgggcagcgcgugaccaucuccugcagcggcgggcccuccaacgucggcgggaacuacguguacugguaccggcaguuccccggcacggcccccaagcuccugauccugcgcgacgaccagcggcccagcggcgugcccgaccgcuucuccgccagcaaguccgggaacagcgccucccucgccaucagcggccugcggcccgacgacgaggcgcuguacuucugcgccaccuacgacuccgacgggagcauccgccucuucggcgggggcaccgcccugaccguccugucccagccgaaggccgcgcccagcgugacccucuucccgcccggcugggaggag

SEQ ID NO: 11966 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcuguuccagggccgcgugagccucacgcggcacgccuccugggacuucgacaccuucagcuucuacauggaccugaaggccgugcgcuccgacgacaccgcggucuacuucugcgcccggcagcgcagcgacuacugggacuucgacguguggggguccggcacccaggugacggucagcuccgccagcaccaagggg

SEQ ID NO: 11967 - RNA, 384 nt, Artificial Sequence
  derived and/or modified sequence opt1 from anti-HIV_Chain
caggugcagcugcuccagagcggcgccgucgugaccaagcccggggccuccgugcgcgucagcugcgaggcguccggcuacaagauccgggacuacuucauccacugguggcgccaggccccggggcagggccugcagugggugggguggaucaacccccagaccggccagcccaacaucccccggccguuccagggccgcgugacgcugacccggcacgccagcugggacuucgacaccuucuccuucuacauggaccucaaggcccugcgcagcgacgacaccgccaucuacuucugcgcgcggcgccgguccgacuacugcgacuucgacgucugggggagcggcacgcacgugaccguguccagcgccuccaccaagggg

SEQ ID NO: 11968 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcaggccuccugggacuucgacaccaucagcuucuacauggaccucaaggcccugcgccuggacgacaccgcgguguacuucugcgcccggcagcgcuccgacuacugggacuucgacgucugggggagcggcacccaggugacgguguccagcgccuccaccaagggg

SEQ ID NO: 11969 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggcccugcgcuccgacgacaccgcgguguacuucugcgcccggcagcgcagcgacuacugggacuucgacgucuggggguccggcacccaggugacgguguacagcgccuccaccaagggg

SEQ ID NO: 11970 - RNA, 384 nt, Artificial Sequence
  derived and/or modified sequence opt1 from anti-HIV_Chain
caggugcagcugcuccccuucggcggggccgucaccaagccgggcgccagcgugcgcguguccugcgaggcgagcggguacaacauccgggacuacuucauccacugguggcgccaggcccccggccaggggcugcagugggucggcuggaucaaccccaagaccggccagcccaacaacccgugccaguuccaggggcgggugucccugacgcgccccgccagcugggacuucgacaccaucuccuucuacauggaccucaaggcccugcggcuggacgacaccgccguguacuucugcgcgcgccagcggagcgacuacugggacuucgacgucuggggcuccgggacccaggugacggugagcuccgccagcaccaagggc

SEQ ID NO: 11971 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccgggugagccugacgcgccaggccuccugggacuucgacaccuacagcuucuacauggaccugaaggcccuccgguccgacgacaccgcgaucuacuucugcgcccgccagcggagcgacuucugggacuucgacguguggggguccggcacccaggucacggugagcuccgccagcaccaagggg

SEQ ID NO: 11972 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccgggugagccugacgcgccaggccuccugggacuucgacaccuacagcuucuacauggaccugaaggccgugcgguccgacgacaccgcgaucuacuucugcgcccgccagcggagcgacuucugggacuucgacgucuggggguccggcacccaggugacggugagcuccgccagcaccaagggg

SEQ ID NO: 11973 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaagaucagcgaccacuucauccacugguggcggcaggccccggggcagggccugcagugggucggguggaucaaccccaagaccggccagcccaacaacccccgccaguuccagggccggaucucccugacgcgccaggccagcugggacuucgacaccuucuccuucuacauggaccucaaggcccugcggagcgacgacaccgcgguguacuucugcgcccgccagcgguccgacuacugggacuucgacgugugggggagcggcacccaggucacgguguccagcgccuccaccaagggg

SEQ ID NO: 11974 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggggcugcgcuccgacgacaccgccaucuacuucugcgcgcggcagcgcagcgacuacugggacuucgacguguggggcuccgggacccaggucacggugagcuccgccagcaccaagggc

SEQ ID NO: 11975 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggcccugcgcuccgacgacaccgcgguguacuucugcgcccggcagcgcagcgacuacugggacuucgacgucuggggguccggcacccaggugacggugagcuccgccagcaccaagggg

SEQ ID NO: 11976 - RNA, 384 nt, Artificial Sequence
  derived and/or modified sequence opt1 from anti-HIV_Chain
cacgugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcaggccuccugggacuucgacaccuucagcuucuacauggaccucaaggcccugcgccuggacgacaccgcgaucuacuucugcgcccggcagcgcuccgacuacugggacuucgacgugugggggagcggcacccaggucacgguguccagcgccuccaccaagggg

SEQ ID NO: 11977 - RNA, 384 nt, Artificial Sequence
  derived and/or modified sequence opt1 from anti-HIV_Chain
caggugcaccugagccacuccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccggaucagccugacgcgccaggccuccugggacuucgacaccuucagcuucuacauggaccugaaggcccuccgguccgacgacaccgcgguguacuucugcgcccgccagcggagcgacuacugggacuucgacguguggggguccggcacccaggucacggugagcuccgccagcaccaagggg

SEQ ID NO: 11978 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggccuccagugggugggguggaucaaccccaagaccggccagcccaacaacccccgccaguuccagggccggaucagccugacgcgccaggccuccugggacuucgacaccuucagcuucuacauggaccugaaggcccuccgguccgacgacaccgccguguacuucugcgcgcgccagcggagcgacuacugggacuucgacgucuggggguccggcacccaggugacggugagcuccgccagcaccaagggg

SEQ ID NO: 11979 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggccuccagugggugggguggaucaaccccaagaccggccagcccaacaacccccgccaguuccagggccggaucagccugacgcgccaggccuccugggacaucgacaccuucagcuucuacauggaccugaaggcccuccgguccgacgacaccgccguguacuucugcgcgcgccaccggagcgacuacugggacuucgacgucuggggguccggcacccaggugacggugagcuccgccagcaccaagggg

SEQ ID NO: 11980 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggccuccagugggugggguggaucaaccccaagaccggccagcccaacaucccccgccaguuccagggccggaucagccugacgcgccaggccuccggggacuucgacaccuucagcuucuacauggaccugaaggcccuccgguccgacgacaccgccguguacuucugcgcgcgccagcggagcgacuacugggacuucggcgucuggggguccggcacccaggugacggugagcuccgccagcaccaagggg

SEQ ID NO: 11981 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgggcacuucauccacugguggcggcaggccccgggccaggggcuccagugggugggcuggaucaaccccaagaccggccagcccaacaacccccgccaguuccaggggcggaucagccugacgcgccaggccuccugggacuucgacaccuucagcuucuacauggaccugaaggcccuccgguccgacgacaccgccguguacuucugcgcgcgccaccggagcgacuacugggacuucgacgucuggggcuccgggacccaggugacggugagcuccgccagcaccaagggc

SEQ ID NO: 11982 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccggaucagccugacgcgccaggccuccugggacuucgacaccuucagcuucuacauggaccugaaggcccuccgguccgacgacaccgcgguguacuucugcgcccgccaccggagcgacuacugggacuucgacguguggggguccggcacccaggucacggugagcuccgccagcaccaagggg

SEQ ID NO: 11983 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccgggugagccugacgcgccaggccuccugggacuucgacaccuacagcuucuacauggggcugaaggccgugcgguccgacgacaccgcgaucuacuucugcgcccgccagcggagcgacuucugggacuucgacgucuggggcuccgggacccaggugacggugagcuccgccagcaccaagggc

SEQ ID NO: 11984 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggccuccagugggugggguggaucaaccccaagaccggccagcccaacaacccccgccaguuccagggccggaucagccugacgcgccaggccuccugggacuucgacaccuucagcuucuacauggaccugaaggcccuccgguccgacgacaccgccguguacuucugcgcgcgccaccggagcgacuacugggacuucgacgucuggggguccggcacccaggugacggugagcuccgccagcaccaagggg

SEQ ID NO: 11985 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggccuccagugggugggguggaucaaccccaagaccggccagcccaacaacccccgccaguuccagggccggaucagccugacgcgccaggccuccugggacuucgacaccuucagcuucuacauggaccuggaggcccuccgguccgacgacaccgccguguacuucugcgcgcgccagcggagcgacuacugggacuucgacgucuggggguccggcacccaggugacggugagcuccgccagcaccaagggg

SEQ ID NO: 11986 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagauccgggacuacuccauccacugguggcgccaggccccggggcagggccuccagugggucggguggaucaacccccagaccggccagcccaacaucccccggccguuccagggccgcaucagccugacgcggcaggccuccugggacuucgacaccuucagcuucuacauggaccuggaggcccuccgcuccgacgacaccgcgguguacuucugcgcccggcagcgcagcgacuacugggacuucgacguguggggguccggcacccaggucacggugagcuccgccagcaccaagggg

SEQ ID NO: 11987 - RNA, 384 nt, Artificial Sequence
  derived and/or modified sequence opt1 from anti-HIV_Chain
caggugcaccugagccaguccggcgccgccgucaccaagcccggggcgagcgugcgcguguccugcgaggccagcggcuacaagaucuccgaccacuucauccacugguggcggcaggccccggggcagggccuccagugggucggguggaucaaccccaagaccggccagcccaacaacccccgccaguuccagggccggaucagccugacgcgccaggccuccugggacuucgacaccuucagcuucuacauggaccugaaggcccuccgguccgacgacaccgcgguguacuucugcgcccgccagcggagcgacuaccgcgacuucgacguguggggguccggcacccaggucacggugagcuccgccagcaccaagggg

SEQ ID NO: 11988 - RNA, 384 nt, Artificial Sequence
  derived and/or modified sequence opt1 from anti-HIV_Chain
caggugcaccugagccaguccggcgccgucgugaccaagcccggggccagcgugcgcgucuccugcgaggcgagcggcuacaagaucuccgaccacuucauccacugguggcggcaggccccggggcagggcccccagugggugggguggaucaaccccaagaccggccagcccaacaacccgcgccaguuccagggccggaucagccucacgcgccaggccuccugggacuucgacaccuucagcuucuacauggaccugaaggcccugcgguccgacgacaccgccguguacuucugcgcgcgccaccggagcgacuacugggacuucgacgucuggggguccggcacccaggugacggugagcuccgccagcaccaagggg

SEQ ID NO: 11989 - RNA, 384 nt, Artificial Sequence
  derived and/or modified sequence opt1 from anti-HIV_Chain
caggugcgccugcuccagagcggcgccgccgucaccaagcccggggcguccgugcgggugagcugcgaggccuccggcuacgagauccgcgacuacuucauccacugguggcggcaggccccggggcagggccugcagugggucggguggaucaaccccaagaccggccagcccaacaacccccgccaguuccagggccgggugagccugacgcgccaggccuccugggacuucgacagcuacuccuucuacauggaccucaaggcccugcggagcgacgacaccgcgguguacuucugcgcccgccagcgguccgacuacugggacuucgacgucugggggagcggcacccaggugaccguguccagcgccuccacgaagggg

SEQ ID NO: 11990 - RNA, 384 nt, Artificial Sequence
  derived and/or modified sequence opt1 from anti-HIV_Chain
caggugcgccugcuccagagcggcgccgccgucaccaagcccggggcguccgugcgggugagcugcgaggccuccggcuacgagauccgcgacuacuucauccacugguggcggcaggccccggggcagggccugcagugggucggguggaucaaccccaagaccggccagcccaacaacccccgccaguuccagggccgggugagccugacgcgccaggccuccugggacuucgacagcuacuccuucuacauggaccucaaggcccugcggagcgacgacaccgggguguacuucugcgcgcgccagcgguccgacuacugggacuucgacgucuggggcagcgggacccaggugaccguguccagcgccuccacgaagggc

SEQ ID NO: 11991 - RNA, 384 nt, Artificial Sequence
  derived and/or modified sequence opt1 from anti-HIV_Chain
caggugcgccugcuccagagcggcgccgccgucaccaagcccggggcguccgugcgggugagcugcgaggccuccggcuacgagauccgcgacuacuucauccacugguggcggcaggccccggggcagggccugcagugggucggguggaucaaccccaagaccggccagcccaacaacccccgccaguuccagggccgggugagccugacgcgccaggccuccugggacuucgacagcuacuccuucuacauggaccucaaggcccugcggagcgacgacaccgcgguguacuucugcgcccgccagcgguccgacuacugggacuucgacgucugggggagcggcucccaggugaccgugagcuccgccagcaccaagggg

SEQ ID NO: 11992 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaaccccugccaguuccagggccgggugagccugacgcgccaggccuccugggacuucgacaccaucagcuucuacauggaccucaaggcccugcggcuggacgacaccgcgguguacuucugcgcccgccagcgguccgacuacugggacuucgacgucugggggagcggcacccaggugacgguguccagcgccuccaccaagggg

SEQ ID NO: 11993 - RNA, 384 nt, Artificial Sequence
  derived and/or modified sequence opt1 from anti-HIV_Chain
caggugcagcugcuccagagcggcgccgccgucaccaagcccggggcguccgugcgcgugagcugcgaggccuccggcuacaacauccgggacuacuucauccacugguggcgccaggccccggggcagggccugcagugggucggguggaucaaccccaagaccggccagcccaacaacccccggcaguuccagggccgcgugagccugacgcggcacgccuccugggacuucgacaccuucagcuucuacauggaccucaaggcccugcgcuccgacgacaccgcgguguacuucugcgcccggcagcgcagcgacuacugggacuucgacgucuggggguccggcacccaggugaucgugagcuccgccagcacgaagggg

SEQ ID NO: 11994 - RNA, 384 nt, Artificial Sequence
  derived and/or modified sequence opt1 from anti-HIV_Chain
caggugcagcugguccagagcggcgccgacgugaagaagcccggggccaccgugaccgucuccugcaagacggacgaggacgaggacgacuuccgcgcgcaccucaugcaguggaugcggcaggccccgggccagcgccuggagugggugggguggaucaagccccagaccggccagcccagcuacgggcagaaguuccagggccgggugacccugacccgcgaggucuccacgagcaccguguuccuccagcugcggaaccugcgcuccgacgacaccgccguguacuacugcgcccggccccgcggcgggcgggacaacuggagcuuccacgucuggggccgcgggacccucgugacgguguccagcgccuccaccaagggc

SEQ ID NO: 11995 - RNA, 384 nt, Artificial Sequence
  derived and/or modified sequence opt1 from anti-HIV_Chain
gaggugcagcuggucgagagcggcgccgaggugaagaagcccggggccuccgugaaggucagcugcaagguguccggcaacagccucaccgaguucuccauccacugggugcgccaggcgccggggaagggccuggaguggaugggcggguucgaccccgaggagggcgagaccguccccgcccagaaguucaaggggcggcugacgaugaccgaggacaccagcaccaacacggccuacauggagcucuccagccugcgcuccgaggacaccgccguguacuacugcagcaccgagccccgggagaugggcacccugacggccggguucgaguacuggggccaggggacccucgugaccgucuccagcgcguccaccaagggc

SEQ ID NO: 11996 - RNA, 384 nt, Artificial Sequence
  derived and/or modified sequence opt1 from anti-HIV_Chain
cgcgugcagcugggccagagcggggccgaggucaagaagcccggcgccuccgugaaggugagcugcaaggucuccgggaacagccucaccgaguucuccauccacugggugcggcaggcgccgggcaaggggcuggaguggaugggcggcuucgaccccgaggagggggagaccgugcccgcccagaaguucaagggccgcgucacgaugaccgaggacaccagcaccaacacggccuacauggagcuguccagccuccgguccgaggacaccgccguguacuacugcagcaccgagccccgcgagauggggacccugacggccggcuucgaguacugggggcagggcacccuggugaucgucuccagcgcguccaccaagggc

SEQ ID NO: 11997 - RNA, 384 nt, Artificial Sequence
  derived and/or modified sequence opt1 from anti-HIV_Chain
caggugcagcugguccagagcggcgccgacgugaagaagcccggggccuccgugaccgucagcugcaagaccgacgaggacgaggacgacuuccgcgcgcaccucgugcaguggaugcggcaggccccgggccagcgccuggagugggugggguggaucaagccccagacgggccagcccuccuacgcccagaaguuccaggggcgggucacccugacccgcgaggugagcaccuccacgguguuccuccagcugcggaaccugcgcagcgacgacaccgccgucuacuacugcgcccggccccgcggcggccgggacaacugguccuuccacgugugggggcgcggcacccucgugaccgucagcuccgcgagcacgaagggg

SEQ ID NO: 11998 - RNA, 384 nt, Artificial Sequence
  derived and/or modified sequence opt1 from anti-HIV_Chain
caggugcagcugcaggagagcggccccgggcucgucaagccguccgagacccugagccugaccugcuccgugagcggcgccuccaucagcaacuucuacuggacguggauccgccagcccgccgggaagggccucgaguggguggggcggcuguacuccagcgaccgcaccaacuacaaccccucccugaacggccgggucaccaugagccucgacaccuccaagaaccaguucagccugcgccugacguccaugaccgacgcggacaccgccaucuacuucugcgcccgggagaagggccaguggcucaccgugcccccguacuacuucgacagcugggggcagggcauccuggugacggucuccagcgccuccaccaagggg

SEQ ID NO: 11999 - RNA, 384 nt, Artificial Sequence
  derived and/or modified sequence opt1 from anti-HIV_Chain
caggugcagcugguccagagcggcgccgaggugcgcaagcccggggccuccgugaaggucagcugcaagaccuccggcuacaccuucacgaacagcuacauccacugggugcggcaggcgccggggcagggccucgaguggauggggaucaucaacccgcccggcggcaacaccuacuacgcccagaaguuccacgggcgcgugacccugacccgggacacguccaccagcaccgucuacauggagcugaacucccuccgcagcgaggacaccgccguguacuucugcgcccggccccacucccccacgaacauccccagccgcccccuggacuacuggggccaggggacccuggugaccgucuccagcgccuccaccaagggc

SEQ ID NO: 12000 - RNA, 384 nt, Artificial Sequence
  derived and/or modified sequence opt1 from anti-HIV_Chain
caggugcagcugcaggagagcggccccgggcucgucaagccguccggcacccugagccugaccugcaacguguacgggggcuccaugaucagcuacuacugguccuggauccgccagccgcccgggaagggccucgaguggaucggccacguguacaacagcgggaacacgaaguacucccccagccugaagaaccgggucaccaucuccauggacaccagccgcaaccuguucucccucaaggugaccagcgugacgcccgccgacaccgccgucuacuacugcgcgcgggccgacuacgacaacaucugggacucccgcggcggguucgaccuguggggccaggggacccuggugaccgugagcuccgccagcacgaagggc

SEQ ID NO: 12001 - RNA, 384 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggacccucuccagcuacaccaucuccugggugcgccaggcgccgggccaggggcuggaguggaugggccggcugaucccccucguggacaucacgaccuacgcccagaaguuccagggccgcgucaccaucaccgccgacacgagcaccaacaccgccuacauggagcuguccaaccugcggagcgaggacaccgccaucuaccacugcgcgacguccaccaugaucgccgccgugaucaacgacgccuucgaccucugggggcagggcaccaccgugacggucagcuccgcgagcaccaagggg

SEQ ID NO: 12002 - RNA, 384 nt, Artificial Sequence
  derived and/or modified sequence opt1 from anti-HIV_Chain
caggugcagcugguccagagcggcgccgaggugaagaagcccggggccuccgugaagaucagcugcaaggcguccggcuacagcuuccgcaacuacgccguccacugggugcggcaggccccggggcagggccucgaguggaugggggagaucaacggcggcaacgggaacaccgaguacucccagaagucccagggccgccugaccaucacgcgggacaucagcgccaccaccgccuacauggagcugagcucccuccgcagcgacgacaccgcgguguacuacugcgcccgggucgccuacgugcacguggucacgacccgcucccuggacaacugggggcagggcacccuggugaccgugagcuccgccagcacgaagggg

SEQ ID NO: 12003 - RNA, 384 nt, Artificial Sequence
  derived and/or modified sequence opt1 from anti-HIV_Chain
caggugcgccugagccaguccggcgccgccgucaugaagaccggggcgagcgugaccaucuccugcgagacggagggcuucaacuucgugaacuacaucauccacuggguccggcggcccccggggcgcggcuucgaguggcucgggaugaucgacccccgcaacggccaccccugguucgcccagaccgugcggggccgccugagccugcggcgcgacaccuucaacgagaucguguacaugacccucuccgggcugacgaccgacgacaccggccuguacuucugcgcccggaacgagccccaguaccacagccucccggggauguucgacuacuggggccaggggacccccgucacgguguccagcgccuccaccaagggc

SEQ ID NO: 12004 - RNA, 384 nt, Artificial Sequence
  derived and/or modified sequence opt1 from anti-HIV_Chain
caggugcgccugagccaguccggcgccgccgucgugaagaccggggcgagcgugaccaucuccugcgagacggagggcuacaacuucgucaacuacaucauccacugggugcggcggcccccggggcgcggcuucgaguggcucgggaugaucgacccccgcaacggccaccccugguucgcccagaccgugcggggccgccugagccugcggcgcgacaccuucaaggagaccgucuacaugacgcucuccgggcugaccagcgacgacaccggcguguacuucugcgcccggaacgagccccaguaccacucccugccggggauguucgacuacuggggccacgggacccccgugacggucagcuccgccagcaccaagggc

SEQ ID NO: 12005 - RNA, 384 nt, Artificial Sequence
  derived and/or modified sequence opt1 from anti-HIV_Chain
cagggccagcuggugcagagcgggggcggggucaagaagcucggcaccuccgugaccaucagcugccuggccuccgaguacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacgagc

SEQ ID NO: 12006 - RNA, 384 nt, Artificial Sequence
  derived and/or modified sequence opt1 from anti-HIV_Chain
caggugcagcugguccagagcggcgccgaggugaagaagcccggggccuccgugaaggucagcugcaaggcguccggcuacaccuucaccagcuacgacaucaacugggugcgccaggccacggggcagggccucgaguggaugggguggaugaacccgaacuccggcaacaccggcuacgcccagaccuuccaggggcgggugaccaugacgcgcaacaccagcaucuccaccgccuacauggagcugagcucccugcggagcgaggacaccgccgucuacuacugcgcgcgcgaccgguggcucccccaguacuacuacuacggcauggacgugugggggcagggcacgaccgugaccgucuccagcgccuccaccaagggg

SEQ ID NO: 12007 - RNA, 384 nt, Artificial Sequence
  derived and/or modified sequence opt1 from anti-HIV_Chain
caggugcagcugguccagagcggcgccgaggugaagaagcccggguccagcaugaagguguccugcaagagcuccggcgggaccuucagcaaccacgccaucuccuggguccgccaggcgccgggcaaggggcucgaguggaugggcggcaucauccccaugagcgggaccacgaacuaccugcagaaguuccagggccgggugaccaucaccgccgacgaguucgccaccacggccuacauggagcuguccagccucaccuccgaggacaccgccguguacuacugcgcgcgcgcccgggccgacagccacacccccaucgacgccuucgacaucugggggcccggcacgcgcgucaucguguccagcgcguccaccaagggg

SEQ ID NO: 12008 - RNA, 384 nt, Artificial Sequence
  derived and/or modified sequence opt1 from anti-HIV_Chain
caggugcagcugguccagagcggcgccgaggugaagaagcccggggccuccgugaaggucagcugcaagguguccggcuacacccucaccgagcugagcauccacugggugcgccaggcgccggggaagcggcuggaguggaugggcggguucgaccccgaggacggcgagcgcaucuacgcccagaaguuccagggccgggucacgaugaccgaggacaccuccaccgacacggccuacauggagcucaacagccugcgcuccgacgacaccgccguguacuacugcgccaccgggggccuguacugcagcuccaucagcugcaucauggacgugugggggcagggcaccacggucaccguguccagcgcguccaccaagggg

SEQ ID NO: 12009 - RNA, 384 nt, Artificial Sequence
  derived and/or modified sequence opt1 from anti-HIV_Chain
caggugcagcugguccagagcggcgccgaggugaagaugcccggggccuccgugaaggucagcugcaagguguccggcuacagccucaccgagcuguccauccacugggugcgccaggcgccggggaagcggcuggaguggaugggcggguucgaccccgaggacgacgagcgcaucuacgcccagaaguuccaggaccgggucaccaugacggaggacaccagcaccgacaccgccuacauggaccucaacucccugcgcagcgaggacacggccguguacuacugcaccaccggcggccuguacugcuccagcaucuccugcaucauggacgugugggggcagggcaccacggucaucgugagcuccgccagcaccaagggg

SEQ ID NO: 12010 - RNA, 387 nt, Artificial Sequence
  derived and/or modified sequence opt1 from anti-HIV_Chain
gaggugcagcugagcgaguccggcgggggcuucgucaagcccgggggcagccuccgccuguccugcgaggccagcggguucaccuucaacaacuacgccauguccugggugcggcaggcgccgggcaagggccuggagugggugagcgucaccuccgcccacgggggcagcgccuacuacggggaguucgugaagggccgcuucacgaugucccgggaccacuucaucgacaccguguaccucgagaugaacgggcugaccgucgaggacaccgccguguacuacugcgugcgcgucacguucuaccacgagggcagcggcuacuacuaccgggccgggaacuacuucgacuccuggggcaaggggacccgcgugguggucagcgcg

SEQ ID NO: 12011 - RNA, 387 nt, Artificial Sequence
  derived and/or modified sequence opt1 from anti-HIV_Chain
gaggugcagcugagcgaguccggcgggggcuucgucaagcccgggggcagccuccgccuguccugcgaggccagcggguucaccuucaacaacuacgccauguccugggugcggcaggcgccgggcaagggccuggagugggugagcgucaccuccgcccacgggggcagcgccuacuacggggaguucgugaagggccgcuucacgaugucccgggaccacuucaucgacaccguguaccucgagaugaaccgccugaccgucgaggacaccgccguguacuacugcgugcgggucacguucuaccacgaggggagcggcuacuacuaccgcgccggcaacuacuucgacuccugggggaagggcacccgggugguggucagcgcg

SEQ ID NO: 12012 - RNA, 387 nt, Artificial Sequence
  derived and/or modified sequence opt1 from anti-HIV_Chain
gaggugcagcugagcgaguccggcgggggcgucgugaagcccgggggcagccuccgccuguccugcgaggccagcggguucaccuucuccaacuacgccaugagcugggugcggcaggcgccgggcaagggccuggagugggucuccgugaccgggggccacgggacguacggcuacuacggggaguucgugaagggccgcuucaccaucagccgggaccacuccauggacaccgucuaccuccagaugaaccgccugcggguggaggacaccgccguguacuacugcguccgcacgcccuacuaccacgagagcuccggcuacuacuaccgggccgggaacuacuucgacuucuggggcaaggggacccuggugaucgugagcgcc

SEQ ID NO: 12013 - RNA, 387 nt, Artificial Sequence
  derived and/or modified sequence opt1 from anti-HIV_Chain
gaggugcagcugagcgaguccggcgggggcuucgucaagcccgggggcagccuccgccuguccugcgaggccagcggguucaccuucaacaacuacgccaugggcugggugcggcaggcgccgggcaaggggcuggaguggguguccgucaccagcgcccacggcggguccgccuacuucggcgaguucgugaaggggcgcuucacgaugagccgggaccacuucaucgacaccguguaccucgagaugaaccgccugaccgucgaggacaccgccguguacuacugcgugcgggucacguucuaccacgagggcuccggcuacuacuaccgcgccgggaacuacuucgacagcuggggccaggggacccuggugaucguguccgcg

SEQ ID NO: 12014 - RNA, 387 nt, Artificial Sequence
  derived and/or modified sequence opt1 from anti-HIV_Chain
caggugcagcuggucgagagcggcgggggccucgugcagcccgggggcucccugcggcugagcugcgccgccuccggguucaccuucagcacccacuggaugcacugggugcggcaggcgccgggcaagggccucgucugggugucccgcauccacagcgacgggcgguccacgagcuacgccgacuccgugaagggccgcuucaccaucagccgggacaacgccaagaacacccuguaccugcagaugaacucccuccgcgccgaggacaccgccgucuacuacugcgcgcgcggggccgccguguucggcguggucaucaucgggggcauggaccuguggggccaggggacgaccgugaccgugagcuccgccagcaccaagggc

SEQ ID NO: 12015 - RNA, 387 nt, Artificial Sequence
  derived and/or modified sequence opt1 from anti-HIV_Chain
caggugcagcuggucgagagcggcggggcccucgugcagcccggcgggucccugcgccugagcugcgccgcguccggcuucagcuucuccagcuacgccauguccugggugcggcaggccccggggaagggccucgagugggucagcgccaucucccgcagcggcggguccaccuacuacgccgacagcgugaagggccgguucaccaucuccaucgacaacagcaacaacacgcuguaccugcagaugaacucccuccgcguggaggacaccgcggucuacuacugcgccaagcgggaggccuucuacuacggggccggcggguacggcauggacguguggggccaggggaccaccgugacggucagcuccgcgagcaccaagggc

SEQ ID NO: 12016 - RNA, 387 nt, Artificial Sequence
  derived and/or modified sequence opt1 from anti-HIV_Chain
uuccagggccaccuggugcagagcgggggcggggucaagaagcccggcaccuccgugacccucagcugccuggccuccgaguacacguucaccgaguucaccauccacuggauccgccaggccccggggcagggcccccuguggcucggccugaucaagcggagcgggcgccugaugaccuccuaccgguuccaggaccgccucagccugcggcgcgaccgguccacgggcaccguguucauggagcugcgcagccuccggaccgacgacaccgcggucuacuacugcgcccgcgacgggcugggcgagcuggcccccgccuaccacuacgggaucgacgccuggggccagggcacgaccgugaucgugaccuccgcgagcaccucc

SEQ ID NO: 12017 - RNA, 387 nt, Artificial Sequence
  derived and/or modified sequence opt1 from anti-HIV_Chain
cagggccugcucgugcagagcgggggcggggucaagaagcugggcaccuccgugaccaucagcugccuggccuccgaguacacguucaacgaguucgugauccacuggauccgccaggcccccgggcagggcccgcucuggcugggccugaucaagcggagcgggcgccucaugaccuccuaccaguuccaggaccggcugagccugcgccgggaccgcuccaccggcaccgucuucauggagcuccgggggcugcgcguggacgacacggcgguguacuacugcgcccgggacggccugggggaggucgcccccgccuaccucuacggcaucgacgccuggggccaggggaccaccgugaucgugaccagcgcguccacgaagggc

SEQ ID NO: 12018 - RNA, 387 nt, Artificial Sequence
  derived and/or modified sequence opt1 from anti-HIV_Chain
aacuucaugcugacccagcccgccagcguguccggcagccccgggcaguccaucaccaucagcugcuccggcacggggagcgacaucggcgucuacaacuacguguccugguaccagcagcaccccgggaaggcgccccgccucaugaucuacgacgugaccaaccggcccagcggcgucuccaaccgcuucagcggcuccaagagcggguucaccgccucccugaccaucagcggccugcagggggacgacgaggccgacuacuacugcuccagcuacuccagcacgaacaccuacguguucggcaccgggacccacgugacgguccucggccagccgaaggccaaccccaccgugacccuguucccgcccuccagcgaggagcug

SEQ ID NO: 12019 - RNA, 387 nt, Artificial Sequence
  derived and/or modified sequence opt1 from anti-HIV_Chain
cagagcgcccugacccagccccgcuccgugagcggcuccccggggcagagcgucaccaucuccugcacgggcaccagcuccgacgugggggccuacaacuacgugagcugguaccggcagcaccccggcaaggcgcccaagcucaugaucaacgacgucuccaagcgccccagcggggugccggaccgguucuccggcagcaaguccggcaacaccgccagccugaccaucuccgggcugcaggccgaggacgaggccgacuacuacugcugcagcuacgccggcacguacuccuacguguucgggaccggcaccaaggucaccgugcucgggcagcccaaggcgaaccccacggugacccuguucccgcccagcuccgaggagcug

SEQ ID NO: 12020 - RNA, 387 nt, Artificial Sequence
  derived and/or modified sequence opt1 from anti-HIV_Chain
cagggccagcuggugcagagcgggggcgggcucaagaagcccggcaccuccgucaccaucagcugccuggccuccgaguacacguucaacgaguucgugauccacuggauccgccaggccccggggcagggcccccuguggcucggccugaucaagcggagcgggcgccugaugaccgcguacaacuuccaggaccggcucucccugcgccgggaccgcagcaccggcaccguguucauggagcugcgggggcuccgccccgacgacacggccgucuacuacugcgcccgggacggccugggggagguggcccccgacuaccgcuacggcaucgacguguggggccagggguccaccgucaucgugaccgccgcgagcaccaagggc

SEQ ID NO: 12021 - RNA, 387 nt, Artificial Sequence
  derived and/or modified sequence opt1 from anti-HIV_Chain
aacuucaugcugacccagcccccgagcgccuccggcgcccccgggcagcgcgugaccaucagcugcuccggcgggcccagcaacgucggcgggaacuacguguacugguaccggcaguuccccggcacggcgcccaaccuccugauccugcgcgacgaccagcggcccuccggcgugcccgaccgcuucagcgccuccaagagcgggaacuccgccagccucgccaucuccggccugcggcccgacgacgaggccuucuacuucugcgcgaccuacgacagcgacggguccauccgccuguucggcgggggcaccacccucacgguccugagccagccgaaggccgcccccuccgugacccuguucccgcccagcuccgaggagcuc

SEQ ID NO: 12022 - RNA, 387 nt, Artificial Sequence
  derived and/or modified sequence opt1 from anti-HIV_Chain
cagcuggugcucacccagcccccgagcgucuccggcgcccccgggcagcgcgugaccaucagcugcuccggcgggcccagcaacgugggcgggaaccuggucuacugguacaagcaguuccccggcacggcccccaagcugcucauccggcgcgacgaccagcggcccuccggcgugcccgaccgcuucagcggguccaagagcggcaacuccgcgagccugaccaucuccgggcugcggcccgacgacgaggccuucuacuucugcgccaccuacgacagccagggcuccacccgccucuucgggggcggcacggugcugaccguccugagccagccgaaggccgcccccuccgugacccucuucccgcccagcuccgaggagcug

SEQ ID NO: 12023 - RNA, 387 nt, Artificial Sequence
  derived and/or modified sequence opt1 from anti-HIV_Chain
aacuucaugcugacgcagccgcccagcguguccggcgcccccgggcagcgcgucaccaucagcugcuccggcgggcccagcaacgugggcgggaaccucguguacugguacaagcaguuccccggcacggcccccaagcugcugauccggcgcgacgaccagcggcccuccggcguccccgaccgcuucagcggguccaagagcggcaacuccgcgagccucgccaucuccgggcugcggcccgacgacgaggccuucuacuucugcgccaccuacgacagccacggcuccauccgccuguucgggggcggcacccuccugaccgugcugagccagccgaaggccgcgcccuccgugacccucuucccgcccagcuccgaggagcug

SEQ ID NO: 12024 - RNA, 387 nt, Artificial Sequence
  derived and/or modified sequence opt1 from anti-HIV_Chain
cagagcgcccugacccgcacccccuccgugagcggcgccccggggcagcgggucacgaucuccugcagcggcgggcccuccaacgugggcgggaacuacguguacugguaccagcaguuccccggcgcggcccccaagcuccugauccgccgggacgaccagcgcccgagcggcguccccgaccgguucuccgggagcaaguccggcaacagcgccucccuggccaucagcgggcuccgccuggacgacgaggccuacuacuucugcgcgaccuacgacuccggcuggagcauccggcuguucgggggcggcacccgccucaccgugcugucccagcccaaggccgcccccagcgugacgcuguucccgcccuccagcgaggagcuc

SEQ ID NO: 12025 - RNA, 387 nt, Artificial Sequence
  derived and/or modified sequence opt1 from anti-HIV_Chain
cagagcgcccugacccagcccccguccgugagcgccacccccggccagacggucaccaucuccugcagcggguccggcagcaacgucgggggcaaccacguguacugguaccgccagcuccccggggcggcccccacccugcugaucuccaagaccgaccaccggcccagccgcgugcccgaccgguucuccgccagcaaguccggcaacagcgccucccucgccaucagcggccugcgccccgacgacgaggcgaucuacuucugcgccacguacgacaccgggcugucccuccggcuguucggcgggggcacccgccugaccgugcucagccagcccaaggccgccccguccgugacgcuguucccgcccagcuccgaggagcug

SEQ ID NO: 12026 - RNA, 387 nt, Artificial Sequence
  derived and/or modified sequence opt1 from anti-HIV_Chain
caggugcagcugcucgagagcggccccgggcuggucaccccguccggcacccugagccucgccugcgccguguccggggcgagcaucuccagcucccacugguggacgugggugcgccagagccccggcaaggggcuggaguggaucggcgagaucgaccggcgcggcaccaccaacuacaaccccucccugcggagccgcgucaccauccuccuggacaacuccaagaaccaguucagccugucccuccggagcgugacggccgccgacaccgccguguacuacugcaccaaggucuacgccgggcuguucaacgagcgcaccuacggcauggacgugugggggcacggcacgaccgugcuggucuccagcgcguccaccaagggg

SEQ ID NO: 12027 - RNA, 387 nt, Artificial Sequence
  derived and/or modified sequence opt1 from anti-HIV_Chain
caggccguggucacgcagccgcccagcguguccgccacccccggccagacggugaccaucagcugcuccgggagcggcuccaacgucgggggcaaccacguguacugguaccgccagcugcccggggcggcccccacccuccugaucagcaagaccaaccggcgccccucccaggugcccgaccgguucagcggcuccaagagcggcaacuccgccagccuggccaucuccgggcuccgccccgacgacgaggccgacuacuucugcgcgacguacgacaccgaccugagccugcgccucuucggcgggggcacccggcugaccguccugucccagcccaaggccgccccgagcgugacccucuucccgcccuccagcgaggagcug

SEQ ID NO: 12028 - RNA, 387 nt, Artificial Sequence
  derived and/or modified sequence opt1 from anti-HIV_Chain
cagagcgcccugacccagcccccguccgugagcggcacccccgggcagaacgucacgaucuccugcagcggcgggggcuccgacgucgggggcaaccucgugagcugguaccagcacuuccccggcgccgcgcccaagcugcugauccaccgcgacaaccagcggccguccggggugcccgaccgcuucagcgcccucaaguccggcaacagcgccucccuggccaucagcgggcugcgguccgacgacgaggccuucuacuucugcgcgguguacgacagcucccucagccugggccuguucgggggcggcaccaagcucaccgugcugucccagcccaaggccgcccccagcgucacccuguucccgcccuccagcgaggagcuc

SEQ ID NO: 12029 - RNA, 387 nt, Artificial Sequence
  derived and/or modified sequence opt1 from anti-HIV_Chain
cagagcgcccugacccagcccccguccgccagcggcacccccgggcagcgcgugacgaucuccugcagcggcgggggcuccaacaucgggggcaaccucgucagcugguaccagcacuuccccggcaccgcgcccaagcugcugaucuaccggaacgaccagcgcccguccggggugcccgaccgguucagcggcuccaagagcgggaccuccgccagccucaccaucuccggccugcgcagcgacgacgaggccacguacuucugcgccgccuacgacuccagccugucccuccggcuguucgggggcggcaccacccugaacgugcucagccagcccaaggcggcccccuccgucacccuguucccgcccagcagcgaggagcug

SEQ ID NO: 12030 - RNA, 387 nt, Artificial Sequence
  derived and/or modified sequence opt1 from anti-HIV_Chain
cagagcgcccugacccagcccccguccgugagcgccacccccggccagacggucaccaucuccugcagcggguccggcagcaacgucgggggcaaccacguguacugguaccgccagcuccccggggcggcccccacccugcugaucuccaagaccaaccaccggcccagccaggugcccgaccgcuucuccgccagcaaguccggcaacagcgccucccucgccaucagcggccugcggcccgacgacgaggcggacuacuucugcgggacguacgacaccucccugagccuccgccuguucggcgggggcacccggcugaccgugcucucccagcccaaggccgccccgagcgugacgcuguucccgcccuccagcgaggagcug

SEQ ID NO: 12031 - RNA, 387 nt, Artificial Sequence
  derived and/or modified sequence opt1 from anti-HIV_Chain
cagagcgugcugacccagguccucuccgugagcggcacccccgggcagcgcgugaucaucuccugcagcggcacguccagcaacgucgggggcaaccugguguccugguaccagcaccucccgggggccgcgccccggcugcugauccaccgcgacgaccagcggcccagcggcgugcccgaccgcuucuccggcagcaaguccgggaacagcgccucccuggucaucagcggccuccgguccgacgacgaggccgacuacuucugcggggccuacgacagcaccuucucccugccgguguucggcgggggcacccgccugaccgugcucagccagcccaaggccgcccccuccgucacgcuguucccgcccagcagcgaggagcug

SEQ ID NO: 12032 - RNA, 387 nt, Artificial Sequence
  derived and/or modified sequence opt1 from anti-HIV_Chain
cagagcgcccugacccagcccccggccaccuccggcacgcccgggcagcgcgugaccaucagcugcuccggcgggggcagcaacgucgggggcaaccucguguccugguaccagcaguuccccggcgcggcccccaagcugauccugcaccgggacgggcagcgccccagcggcgugcccgaccgguucuccgccagcaaguccgggaccagcgccucccucaccaucagcggccugcgcuccgacgacgaggccacguacuucugcgcggccuucgacagcgcccugucccucccccuguucgggggcggcaccaagcugaccguccucagccagcccaaggccgcgccguccgugacccuguucccgcccagcuccgaggagcug

SEQ ID NO: 12033 - RNA, 387 nt, Artificial Sequence
  derived and/or modified sequence opt1 from anti-HIV_Chain
cagcuggugcucacccagcccccgagcgucuccgccacccccggccagacggugaccaucagcugcuccgggagcggcuccaacgucgggggcaaccacgucuacugguaccgccagcugcccggggccgcgcccacccuggugaucagcaagaccgaccaccggcccucccgcgugcccgaccgguucagcggcuccaagagcggcaacuccgccagccucgccaucuccgggcugcgccccgacgacgaggccgccuacuucugcgcgacguacgacaccggccugagccuccggcuguucgggggcgggacccgccuggccgugcucucccagcccaaggccgccccgagcgugacccuguucccgcccuccagcgaggagcug

SEQ ID NO: 12034 - RNA, 387 nt, Artificial Sequence
  derived and/or modified sequence opt1 from anti-HIV_Chain
cagagcgcccugacccagcccccguccgugagcggcacccccgggcagaacgucacgaucuccugcagcggcgggggcuccaacgucgggggcaaccucgugagcugguaccagcacuuccccggcgccgcgcccaagcugcugauccaccgcgacaaccagcggcccuccggggugcccgaccgcuucagcgugcucaaguccggcaacagcgccucccuggccaucagcgggccccgguccgacgacgaggccuucuacuucugcgccguguacgacagcucccugagccucggccuguucgggggcggcaccaagcugaccguccucucccagcccaaggcggccccgagcgugacccuguucccgcccuccagcgaggagcug

SEQ ID NO: 12035 - RNA, 387 nt, Artificial Sequence
  derived and/or modified sequence opt1 from anti-HIV_Chain
cagacgguggucacccagcccccgagcgccuccggcacgcccgggcagcgggugaccaucagcugcuccggcgggggcagcaacaucgggggcaaccugguguccugguaccagcacuuccccggcgccgcgcccaagcuccugaucuaccggaacgaccagcgcccgagcgggguccccgaccgguucuccggcagcaaguccgggaccagcgccucccugaccaucagcggccuccgcuccgacgacgaggccacguacuucugcgccgccuacgacugcacccugagccugcgccucuucgggggcggcaccacccugaacgugcugucccagcccaaggcggcccccagcgugacccucuucccgcccuccagcgaggagcug

SEQ ID NO: 12036 - RNA, 387 nt, Artificial Sequence
  derived and/or modified sequence opt1 from anti-HIV_Chain
cagagcgcccugacccagacccccuccgugagcggcgccccggggcagcgcgucacgaucuccugcagcggcgggcccuccaacgugggcgggaacuacguguacugguaccagcaguuccccggcgcggcccccaagcuccugauccggcgcgacgaccagcggccgagcggcguccccgaccgcuucuccgggagcaaguccggcaacagcgccucccuggccaucagcgggcuccggcuggacgacgaggccuacuacuucugcgcgaccuacgacuccggcuggagcauccgccuguucgggggcggcacccggcucaccgugcugucccagcccaaggccgcccccagcgugacgcuguucccgcccuccagcgaggagcuc

SEQ ID NO: 12037 - RNA, 387 nt, Artificial Sequence
  derived and/or modified sequence opt1 from anti-HIV_Chain
cagagcgugcugacccagcccccguccgccagcggcgcccccgggcagcgcgucaccaucuccugcagcggcgggcccuccaacgugggcgggaacuacguguacugguaccggcaguuccccggcacggcgcccaaccuccugauccugcgcgacgaccagcggcccagcggcguccccgaccgcuucuccgccagcaaguccgggaacagcgccucccucgccaucagcggccugcggcccgacgacgaggccuucuacuucugcgcgaccuacgacuccgacgggagcgugcgccuguucggcgggggcaccacccucacggugcugucccagccgaaggccgcccccagcgucacccuguucccgcccuccaacggcgggcgg

SEQ ID NO: 12038 - RNA, 387 nt, Artificial Sequence
  derived and/or modified sequence opt1 from anti-HIV_Chain
cagggccagcuggugcagagcgggggcggggucaagaagcccggcaccuccgugaccaucagcugccucgccuccgaguacacguucaacgaguucgugauccacuggauccgccaggccccggggcagggcccccuguggcugggccucaucaagcggagcgggcgccugaugaccuccuacaaguuccaggaccggcugaaccuccgccgggaccgcagcaccggcaccgucuucauggagcugcgggggcugcgccccgacgacacggcgguguacuacugcgcccgggacggccucggggagguggcccccgacuaccgcuacggcaucgacgucuggggccagggguccaccgugaucgugaccgccgccagcaccaagggc

SEQ ID NO: 12039 - RNA, 387 nt, Artificial Sequence
  derived and/or modified sequence opt1 from anti-HIV_Chain
gaggugcagcuggucgagagcggcgccgaggugaagaagcccggggccuccgugaaggucgccugcaaggugagcggcaagaagcucuccgaccugagcauccacugggugcgccaggccccggggaagggccuggaguggaugggcggguucgacgaggaggacggcaagaucuccuacgagcggaaguuccaggggcgcgucaccaugaccgaggacacggcccgggacaccgccuucauggagaugagcucccuccgcagcgacgacaccgccguguacuucugcgcggccgcgccccggcuggaccugggcgagcucuccagcggguuccacuucuggggccuggggacccugguguccgucagcuccgccagcacgaagggc

SEQ ID NO: 12040 - RNA, 387 nt, Artificial Sequence
  derived and/or modified sequence opt1 from anti-HIV_Chain
cagggccagcuggugcagagcgggggcgggggcaagaagcucgggaccuccgucaccaucagcugccuggccuccgaguacacguucaacgaguucgugauccacuggauccgccaggcccccggccagggcccgcuguggcucgggcugaucaagcggagcggccgccugaugaccuccuaccaguuccaggaccggcucagccugcgccgggaccgcuccaccgggaccguguucauggagcugcggggccuccgcgucgacgacacggcgguguacuacugcgcccgggacgggcugggcgagguggcccccgccuaccuguacggcaucgacgccugggggcagggcaccaccgucaucgugagcuccgcgagcaccaagggg

SEQ ID NO: 12041 - RNA, 387 nt, Artificial Sequence
  derived and/or modified sequence opt1 from anti-HIV_Chain
gaggugcagcuggucgagagcggcgccgaggugaagaagcccggggccuccgugaaggucagcugcaagguguccggcuacacccucagcgaccuguccaugcacugggugcgccaggcgccggggaagggccuggaguggaugggcggguucgacgaggaggacggcgagaucaccuacgcccagaaguuccaggggcgggucagcaugacggaggacaccucccgcgacaccgccuacauggagcucagcucccugcggagcgaggacaccgccguguacuacugcgccacggcgccccgccuggagcucggcgagcuguccagcggguuccacuacuggggccuggggacccucgugaccgucuccagcgccuccaccaagggc

SEQ ID NO: 12042 - RNA, 387 nt, Artificial Sequence
  derived and/or modified sequence opt1 from anti-HIV_Chain
cagggccagcuggugcagagcgggggcggggucaagaagaccggcaccuccgugacgaucagcugccucgccuccgaguacaccuucaccgaguucaccauccacuggauccgccaggcccccgggcagggcccgcuguggcugggccucaucaagcggagcgggcgccugaugacggcgaaccgguuccaggaccgccugucccuccggcgcgaccggagcaccggcaccguguucauggagcugcgcucccugcggaucgacgacaccgccgucuacuacugcgcccgcgacgggcucggcgagcuggcccccgccuaccacuacgggaucgacguguggggccagggcacgaccaucaucgugaccagcgcguccaccaagggg

SEQ ID NO: 12043 - RNA, 387 nt, Artificial Sequence
  derived and/or modified sequence opt1 from anti-HIV_Chain
cagggccagcuggugcagagcgggggcggggucaagaagcucggcaccuccgugaccaucagcugccuggccuccgaguacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacgaagggc

SEQ ID NO: 12044 - RNA, 387 nt, Artificial Sequence
  derived and/or modified sequence opt1 from anti-HIV_Chain
cagggccagcuggugcagagcgggggcggggucaagaagcucggcaccuccgugaccauccccugccuggccagcgaguacacguucaacgaguucgugauccacuggauccgccaggccccggggcagggcccccuguggcucggccugaucaagcgguccgggcgccugaugaccagcuaccaguuccaggaccggcucucccugcgccgggaccgcagcaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccuccgcgagcacgaagggc

SEQ ID NO: 12045 - RNA, 387 nt, Artificial Sequence
  derived and/or modified sequence opt1 from anti-HIV_Chain
cagggccagcuggugcagagcgggggcggggucaagaagcccggcaccuccgugaccaucagcugccucgccuccgaguacacguucaacgaguucgugauccacuggauccgccaggccccggggcagggccccgucuggcugggccugaucaagcggagcgggcgccucaugaccuccuacaaguuccaggaccggcugagccugcgccgggaccgcuccaccggcaccguguucauggagcuccgggggcugcgccuggacgacacggcgguguacuacugcgcccgggacggccucggggaggucgcccccgccuaccuguacggcaucgacgccuggggccaggggagcaaggugaucgugacccccgcguccaccaagggc

SEQ ID NO: 12046 - RNA, 387 nt, Artificial Sequence
  derived and/or modified sequence opt1 from anti-HIV_Chain
caggcccgccuggaccaguggggcaccgggcugcugaagcccagcgagacccugucccucaagugcgccguguucggcguccuguucacggacuacaacuggaccugggugcggcagagcccggggaaggagcuggaguggaucggccaccucgaccaccgcgggggcggcaacuacaaccccucccuggagagccgggugaccaucucccuggacuacagcaaggcgcaguucucccuccaccucaagagcgucaccguggccgacacggcccgcuacuacugcgccggggccgugaagggcuucugguucgacgaccccuacaccugguucgggcccuggucccagggcacccuggucaccguggcgagcgccuccacgaagggg

SEQ ID NO: 12047 - RNA, 387 nt, Artificial Sequence
  derived and/or modified sequence opt1 from anti-HIV_Chain
caggcccgccuggaccaguggggcaccgggcugcugaagcccagcgagacccugucccucaagugcgccguguucggcguccuguucacggacuacaacuggaccugggugcggcagagcccggggaagggccuggaguggaucgggcaccucgaccaccgcggcggcggguccuacaaccccagccuggagucccgggugagcaucucccuggacuacagcaaggcgcaguucucccuccaccucaagagcgucaccguggccgacaccgcccuguacuacugcgccggcgccgugaagggguucugguucgacgagcccuccacgugguucggccccuggagccaggggaccauggucaccguggcguccgccagcaccaagggc

SEQ ID NO: 12048 - RNA, 387 nt, Artificial Sequence
  derived and/or modified sequence opt1 from anti-HIV_Chain
cagggccaccuggugcagagcgggggcggggucaagaagcucggcaccuccgugaccaucagcugccuggccuccgaggacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacgaagggc

SEQ ID NO: 12049 - RNA, 387 nt, Artificial Sequence
  derived and/or modified sequence opt1 from anti-HIV_Chain
caggugcagcugguccagagcgaggccgaggugaagaagcccggcuccagcgugaaggucuccugcaaggccagcgggggcaccuuccgcggguacaccaucuccugggugcggcaggcgccgggccaggggcucgaguggaugggccgcaucauccccauccugggcaaggccaucuacgcccccagcuuccaggggcgggugacgcugaccgccgacaaguccaccggcaccgccuacauggagcucagccgccugcgguccgacgacacggcggucuacuacugcgccaaggugaagaugcgcgggagcuccggcuacuacuaccuguucgacgacugggggcagggcacccucgugaccgucagcuccgccagcaccaagggc

SEQ ID NO: 12050 - RNA, 387 nt, Artificial Sequence
  derived and/or modified sequence opt1 from anti-HIV_Chain
caggcccgccuggaccaguggggcaccgggcuccugaagcccagcgagacccugucccucaagugcgccguguucggcguccuguucacggacuacaacuggaccugggugcggcagagcccggggaagggccuggaguggaucgggcaccucgaccaccgcggcggcgggaacuacaaccccucccuggagagccgggugaccaucucccuggacuacagcaaggcgcaguucucccuccaccucaagagcgucaccguggccgacacggcccuguacuacugcgccggcgccgugaagggguucugguucgacgaggucuacaacugguucggccccuggucccaggggacccuggugaccguggcgagcgccuccaccaagggc

SEQ ID NO: 12051 - RNA, 387 nt, Artificial Sequence
  derived and/or modified sequence opt1 from anti-HIV_Chain
cagggccagcuggugcagagcgggggcggggucaagaagcccggcaccuccgugaccaucagcugccucgccuccgaguacacguucaccgaguucaccauccacuggauccgccaggccccggggcagggcccccuguggcugggccucaucaagcggagcgggcgccugaugaccgcguaccgguuccaggaccgccugucccuccggcgcgaccggagcacgggcaccguguucauggagcugcgcaaccugcggauggacgacaccgccgucuacuacugcgcccgcgacgggcucggcgagcuggcccccgccuaccaguacgggaucgacguguggggccagggcaccacggugaucgucuccagcgcguccaccaagggg

SEQ ID NO: 12052 - RNA, 387 nt, Artificial Sequence
  derived and/or modified sequence opt1 from anti-HIV_Chain
caggugcgccugguccagagcggcccccaggugaagcggccgggggccuccauccgccucagcugcgaguccagcggcuaccgguuccaggacuacaucguggccuggauccgccagacccgggggcagggcuucgaguucgucgggauggugaacccccgcggcggccggcccuggcccuccagccgcuuccgggaccgcgugacccugacgcgggacaucgaguccgagaccuucuaccuggggcucaacgaccugaccagcgacgacaccgcgacguacuucugcgcccgccuggaggccgacggcuccgacuacagcccgaagauguucgacuucugggggcagggcaccaagaucgucgugucccccgccagcaccaagggg

SEQ ID NO: 12053 - RNA, 387 nt, Artificial Sequence
  derived and/or modified sequence opt1 from anti-HIV_Chain
caggugcgccugguccagagcggcccccaggugaagaccccgggggccuccaugcgggugagcugcgaggccuccggcuaccgcuuccucgacuacaucaucgucuggauccggcagacccacgggcagcacuucgaguacgugggcaugaucaacccccgcgggggcacgcccuggcccagcuccaaguuccgggaccgccugagccugacccgggacauccacaccgacaccuucuaccucggccugaacaaccugggguccgacgacacggcgaucuacuucugcgcccgccucgaggccgacggcgacgacuacagcccgaagauguucgaccacugggggcagggcacccggaucaucguguccgccgccagcaccaagggg

SEQ ID NO: 12054 - RNA, 387 nt, Artificial Sequence
  derived and/or modified sequence opt1 from anti-HIV_Chain
caggugcgccugguccagagcggcccccaggugaagaccccgggggccuccauccggcucagcugcgaggccuccggcuaccgcuuccuggacuacuucaucguguggguccggcagacccccgggcagggcuucgaguacguggggaugaucaacccccgcggcggccggcccuggagcuccuggaaguuccgcgaccggcugagccucacgcgcgagaucgacaccgacaccuucuaccuggggcuguccaaccuccggagcgacgacaccgcgaucuacuucugcgcccgccuggaggccgacggcgacgacuacuccccgaagaugguggacuacugggggcagggcacgaagaucaucgucagcgccgccuccaccaagggg

SEQ ID NO: 12055 - RNA, 387 nt, Artificial Sequence
  derived and/or modified sequence opt1 from anti-HIV_Chain
caggugcgccugguccagagcggcccccaggugaagcggccgggggccuccauccgccucagcugcgagaccuccggcuaccgguuccaggacuacaucguggccuggauccgccagacccgggggcagcgcuucgaguucgucggcauggugaacccccgcgggggccggcccuggcccagcuccaaguuccgggaccgcgugacgcugacccgggacaucgagagcgagaccuuccaccugggccucaacgaccugaccuccgacgacacggcgaccuacuucugcgcccgccuggaggccgacggggccgacuacagcccgaagauguucgacuucuggggccaggggaccaagaucgucgugucccccgccagcaccaagggc

SEQ ID NO: 12056 - RNA, 387 nt, Artificial Sequence
  derived and/or modified sequence opt1 from anti-HIV_Chain
caggugcgccugguccagagcggcccccaggugaagaccccgggggccuccaugcggaucagcugcgaggccuccggcuaccgcuuccaggacuacaucaucguguggauccggcagacccacgggcagggcuucgaguacgucgggaugaucaacccccgcggcggcacgcccuggagcuccagcaaguuccgggaccgccucucccugacccgggacaucuacaccgacaccuucuaccuggggcucaacaaccugggcagcgacgacacggcgaucuacuucugcgcccgccuggaggccgacgggggcgacuacucccccaagauguucgacuacugggggcagggcacccggaucaucgugagcgccgccuccaccaagggc

SEQ ID NO: 12057 - RNA, 387 nt, Artificial Sequence
  derived and/or modified sequence opt1 from anti-HIV_Chain
cagggccagcuggugcagagcgggggcggggucaagaagcccggcgccuccgugaccaucagcugccucgccuccgaguacaccuucaacgaguucgugauccacuggauccgccaggcgccggggcagggcccccuguggcugggccucaucaagcggagcgggcgccugaugacggccuacaaguuccaggaccggcugucccuccgccgggaccgcagcaccggcaccgucuucauggagcugcgggggcugcgccccgaggacaccgccguguacuacugcgcccgggacggccucggggagguggcccccgacuaccgcuacggcaucgacgucuggggccagggguccacggugaucgugagcgcggccuccaccaagggc

SEQ ID NO: 12058 - RNA, 387 nt, Artificial Sequence
  derived and/or modified sequence opt1 from anti-HIV_Chain
caggugcgccugguccagagcggcccccagaugaagaccccgggggccucccuccggcugagcugcgagguguccggcuaccgcuuccuggacuacuucaucguguggguccggcagaccgggggccagggguucgaguacgugggcaugaucaacccccgcggcgggcggcccuggagcuccuggaaguuccgcgaccggcucagccugacgcgcgacaucgagaccgacaccuucuaccugggccucaacaaccugcgguccgacgacaccgccaucuacuucugcgcgcgccuggaggccgacggggacaacuacagccccaagaugguggacuacuggggccaggggacgaagaucaucgucuccccggccagcaccaagggc

SEQ ID NO: 12059 - RNA, 387 nt, Artificial Sequence
  derived and/or modified sequence opt1 from anti-HIV_Chain
caggugagccugguccaguccggcccccaggugaagaccccgggggccagcaugcgcguguccugcgagaccagcggcuaccgguuccucgacuacaucaucgucuggauccgccagacgcacgggcagcacuucgaguacgugggcaugaucaacccccgcgggggcacccccuggcccuccagcaaguuccgggaccggcugaccaugacccgcgacauccacacggacaccuucuaccugggccucaacaaccugcgguccgacgacaccgccaucuacuucugcgcgcgccuggaggccgacggggacgacuacagcccgaagauguucgacuacuggggccaggggacccggaucaucguguccgccgccagcacgaagggc

SEQ ID NO: 12060 - RNA, 387 nt, Artificial Sequence
  derived and/or modified sequence opt1 from anti-HIV_Chain
caggugcgccugguccagagcggcccccaggugaagaccgccggggccuccaugcgggugagcugcgaggcguccggcuaccgcuuccucgacuacaucaucgucuggauccggcagacccacgggcagcacuucgaguacgugggcaugaucaacccgcgcgggggcacgcccuggcccagcuccaaguuccgggaccgccugacccugacccgggacaucuacaccgacacguucuaccucggccugaacaaccuggggagcggcgacaccgccaucuacuucugcgcccgccucgaggccgacggggacgacuacucccccaagauguucgacuacuggggccaggggacccggaucaucgugagcgccgcguccaccaagggc

SEQ ID NO: 12061 - RNA, 387 nt, Artificial Sequence
  derived and/or modified sequence opt1 from anti-HIV_Chain
cagggccagcuggugcagagcgggggcggggucaagaagcccggcaccuccgugaccaucagcugccucgccuccgaguacacguucaacgaguucgugauccacuggauccgccaggccccggggcagggccccgucuggcugggccugaucaagcggagcgggcgccucaugaccuccuacaaguuccaggaccggcugagccugcgccgggaccgcuccaccggcaccguguucauggagcuccgggggcugcgccuggacgacacggcgguguacuacugcgcccgggacggccucggggaggucgcccccgccuaccuguacggcaucgacgccuggggccaggggagcaccgugaucgugaccuccgcgagcaccaagggc

SEQ ID NO: 12062 - RNA, 387 nt, Artificial Sequence
  derived and/or modified sequence opt1 from anti-HIV_Chain
cagggccagcuggugcagagcgggggcgggcucaagaagcccggcaccuccgucaccaucagcugccuggccuccgaguacacguucaacgaguucgugauccacuggauccgccaggccccggggcagggcccccuguggcucggccugaucaagcggagcgggcgccugaugaccgcguacaacuuccaggaccggcuccgccugcggcgcgaccgguccaccggcaccguguucauggagcugcgcgggcuccggcccgacgacacggccgucuacuacugcgcccgcgacggccugggggagguggcccccgacuaccgguacggcaucgacguguggggccaggggagcaccgucaucgugaccgccgcguccaccaagggc

SEQ ID NO: 12063 - RNA, 387 nt, Artificial Sequence
  derived and/or modified sequence opt1 from anti-HIV_Chain
cagggccaccuggugcagagcgggggcggggucaagaagcucggcaccuccgugaccaucagcugccugguguccgaguacacguucaacgaguucgucauccacuggauccgccaggcccccgggcagggcccgcuguggcucggccugaucaagcggagcgggcgccugaugaccuccuaccaguuccaggaccggcucagccugcgccgggaccgcuccaccggcaccguguucauggagcugcgggggcuccgcguggacgacacggccgucuacuacugcgcgcgggacggccugggggagguggcccccgccuaccuguacggcaucgacgccuggggccaggggaccaccgugaucgucaccagcgccuccacgaagggc

SEQ ID NO: 12064 - RNA, 387 nt, Artificial Sequence
  derived and/or modified sequence opt1 from anti-HIV_Chain
cagggccagcuggugcagagcgggggcggggucaagaagcucggcaccuccgugaccaucagcugccuggccuccgaguacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugagcuccgcgagcaccaagggc

SEQ ID NO: 12065 - RNA, 387 nt, Artificial Sequence
  derived and/or modified sequence opt1 from anti-HIV_Chain
cagggccaccuggugcagagcgggggcggggucaagaagcucggcaccuccgugaccaucagcugccuggccuccgaguacacguucaacgaguucgugauccacuggauccgccaggcccccgggcagggcccgcuguggcucggccugaucaagcggagcgggcgccugaugaccuccuaccaguuccaggaccggcucagccugcgccgggaccgcuccaccggcaccgucuucauggagcugcgggggcuccgcguggacgacacggcgguguacuacugcgcccgggacggccugggggaggucgcccccgccuaccuguacggcaucgacgccuggggccaggggaccaccgugaucgugaccagcgcguccacgaagggc

SEQ ID NO: 12066 - RNA, 387 nt, Artificial Sequence
  derived and/or modified sequence opt1 from anti-HIV_Chain
caggugcagcugguccagagcggcuccgagcucaagaagcccggggccagcgugaagguguccugcaaggccagcggcuacaccuucaccuccuacgcgaucaacuggguccgccaggccccggggcagggccuggaguggaugggguggaucaacacgaacaccggcaaccccaccuacgcccagggcuucaccgggcgguucguguucagccuggagacguccgugagcaccgccuaccuccagaucaacucccugaaggccgaggacaccgcggucuacuacugcgcccgcgaccugcucgagagccggaccuacuacaacgacauccgcgacugcuggggccaggggacgcuggugaccguguccagcgccuccaccaagggc

SEQ ID NO: 12067 - RNA, 387 nt, Artificial Sequence
  derived and/or modified sequence opt1 from anti-HIV_Chain
caggugcagcugguccagagcggcgccgaggugaagaagcccggggccuccgugaaggucagcugcaaggcguccggcuacaccuucaccgacuacuacauccacugggugcgccaggccccggggcagggccucgaguggaugggguggaucaaccccagcacgggcggcaccaacuucgugcagaaguuccuggggcgggucaccaugaccuccgacacgagcaucaacaccgccuacauggagcugcgccggcucaagaacgacgacgccgccaucuacuacugcgcgaccuacuccacccgccaguucuuccacuacuacuacgugacggacguguggggccaggggaccaccgucaccgugagcuccgccagcacgaagggc

SEQ ID NO: 12068 - RNA, 387 nt, Artificial Sequence
  derived and/or modified sequence opt1 from anti-HIV_Chain
uuccagggccagcuggugcagagcgggggcggggucaagaagcccggcuccagcgugaccaucuccugccucgccagcgaguacaccuucacggaguucaccauccacuggauccgccaggccccggggcagggcccccuguggcugggccucaucaagcgguccgggcgccugaugaccagcuacggcuuccaggaccggcuguccgugcgccgggaccgcagcaccgggacggucuucauggagcuccggucccugcgcaccgacgacaccgcgguguacuacugcgcccgggacggccugggggagcucgcccccgccuaccacuacggcaucgacguguggggccaggggaccacggucaucgugaccagcgccuccaccagc

SEQ ID NO: 12069 - RNA, 387 nt, Artificial Sequence
  derived and/or modified sequence opt1 from anti-HIV_Chain
caggugcagcuggucgagagcggcgggggcguggugcagcccgggcgcucccuccggcugagcugcgccgccuccggcuucaccuucagcuccuacgcgaugcacuggguccgccaggccccggggaagggccuggaguggguggccgugaucagcuacgacggcuccaacaaguacuacgccgacagcgucaaggggcgguucaccaucucccgcgacgacagcaaguccacgguguaccuccagaucaacagccugcgggccgcggacaccgccguguacuucugcgcccgcgagggcgggcugcgguuccucgaguggcuguucuggggccaggggacccuggucaccguguccagcggcgaguccagcgccuccacgaagggc

SEQ ID NO: 12070 - RNA, 390 nt, Artificial Sequence
  derived and/or modified sequence opt1 from anti-HIV_Chain
caggugcagcugguccagagcggcgccguggugaagucccccgggagcuccgccaagcucagcugccgccugcugggcgacgaguucgggaccuacuucaucuccuggauccggcaggcgccgggccgcgggcucgagugggucggcggcaucgugccccacagccagcugcaguccagcgcccagaaguuccacgggcgguucuucaucaccggcggggugacgccgcccaucaucuuccugcagcucaccaacgucaccuucgaggacaccggcacguacuucugcgcccgcgagcgggggcgccaccgggaccccaagaccggcaagucccugcgcggccgguacuucgacuucugggggcgcggcaccggggugaccgugagcccc

SEQ ID NO: 12071 - RNA, 390 nt, Artificial Sequence
  derived and/or modified sequence opt1 from anti-HIV_Chain
cagaucgagcugcgccagagcggcgccgccaugaagucccccgggagcuccgugaagcucagcugcaccguccugggcgagaacuucgggaccuacuucaucuccuggauccggcaggcgccgggccaggggcuggagugggugggcggcaucgugccccacagccagcuccaguccagcgcccagaaguuccacgggcgcaucaagaucuccggcgggggcacgccgcccgucgugagccuggagcugaccaacgugaccuucgacgacaccgggacguacuucugcgcccgggagcgcggccggcacgucgagcccaagaccggcgaccgccucgccgggcgguacuucgacaucuggggccgcgggaccggccugcggguguccccc

SEQ ID NO: 12072 - RNA, 390 nt, Artificial Sequence
  derived and/or modified sequence opt1 from anti-HIV_Chain
gaggugcagcuggucgagagcggcgggggccucgugaagcccgggggcucccugcgccugagcugcgaggccuccggguucaccuucaccaacgccuggaugaacugggugcggcaggcgccgggcaagggccucgagugggucgggcgcaucaagagccagacgcacggcgggaccacccgguacgccgcccccgugaagggccgcuucaccaucucccgggacgacagcaagcacacgcuguaccugcagauggaccgccucaccaccgaggacaccgccguguacuacugcacggggaccaucaccggcuccaccuucuacuacuacggcauggacgucugggggcagggcacgaccgugaccgugagccccgccuccaccaagggg

SEQ ID NO: 12073 - RNA, 390 nt, Artificial Sequence
  derived and/or modified sequence opt1 from anti-HIV_Chain
gugguccagcuggugcagagcggccccgggcucgugaagcccucccagacccugagccugaccugcacggucuccggcgggagcaucuccagcggcgacuucuacugguccuggauccgccagccgcccgggaagggccucgaguggaucggcuacaucuacuacagcggguccaccuacuacaaccccagccugaagucccggcugaccaucagcguggacaccuccaagaaccaguucagccuccgccuguccagcgugacggccgccgacaccgcggucuacuacugcgcccgggaccugaacucccgcaucgugggcgcccucgacgccuucgacaucugggggcagggcaccauggugaccgucagcuccgccagcacgaagggg

SEQ ID NO: 12074 - RNA, 390 nt, Artificial Sequence
  derived and/or modified sequence opt1 from anti-HIV_Chain
gaggugcagcugguccagagcggcgggggccucgugcagcccgggcgcucccugcggcugagcugcgccgccuccggcuucaccuucgacgacuacgcgaugcacugggugcgccaggccccggggaagggccucgagugggucagcggcaucuccuggaacagcgggaccaucggcuacgccgacuccgugcgggggcgcuucacgaucagccgggacgacgccaaguccagccuguaccugcagaugaacucccuccgcaccgaggacaccgcccuguacuacugcgcgaaggacggcuggguggggagcggcuccagcacccugcggggcuccgacuacugggggcagggcacgcucgucaccgugagcuccgccagcaccaagggg

SEQ ID NO: 12075 - RNA, 390 nt, Artificial Sequence
  derived and/or modified sequence opt1 from anti-HIV_Chain
cagagcgugcugacccagccgcccuccgccagcggcucccccgggcagagcaucaccaucuccugcacgggcaccagcuccgacgucgggggcuacaacuacgugagcugguaccagcagccgcccgggaaggcccccaaggugaucaucuacgaggucuccaagcgccccagcggcgugcccgaccgguucuccggcagcaaguccgggaacaccgcgagccucaccguguccggccugcaggccgaggacgaggccgacuacuacugcagcuccuacgccgggagcaacaacuucgucuucggcacggggaccgaggugaccguggucggccagcccaaggccaaccccaccgugacgcuguucccgcccuccagcgaggagcuccug

SEQ ID NO: 12076 - RNA, 390 nt, Artificial Sequence
  derived and/or modified sequence opt1 from anti-HIV_Chain
caggccguggucacccaggagcccagccugaccgugucccccggcgggacggugacccugaccugcgccagcuccaccggcgcggucacgagcggguucuacccccacugguuccagcagaagcccggccaggcgccccgcgcccucaucuacuccaccagcaaccgguacuccuggaccccggcccgcuucagcgggucccugcucggcggcaaggccgcccugacccugagcggggugcagcccgaggacgaggccgaguacuacugccuccugcugcccuacuacggcgggcccuggaucuucggcgggggcacgaagcucaccgugcugggccagccgaaggccgcccccuccgucacccuguucccgcccagcuccgaggagcuc

SEQ ID NO: 12077 - RNA, 390 nt, Artificial Sequence
  derived and/or modified sequence opt1 from anti-HIV_Chain
cagagcgcccugacccagcccccguccgccagcggcgcgcccgggcagcgcgugaccaucuccugcagcggcgggcccuccaacgucggcgggaacuacguguacugguaccggcaguuccccggcacggcccccacccuccugauccugcgcgacgaccagcggcccagcggcgugcccgaccgcuucuccgccagcaaguccgggaacagcgccucccucgccaucagcggccugcggcccgacgacgagggguucuacuucugcgcgaccuacgacuccgacggcagcauccgccuguucgggggcggcaccgcccucacgguccugucccagccgaaggccgcccccagcgugacccuguucccgcccuccagcgaggagcucaag

SEQ ID NO: 12078 - RNA, 390 nt, Artificial Sequence
  derived and/or modified sequence opt1 from anti-HIV_Chain
caggugcagcuggucgagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12079 - RNA, 390 nt, Artificial Sequence
  derived and/or modified sequence opt1 from anti-HIV_Chain
gaggugcagcuggucgagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12080 - RNA, 390 nt, Artificial Sequence
  derived and/or modified sequence opt1 from anti-HIV_Chain
gaggugcagcugguccagagcggcuccgacgugcgcaagcccggggccaccgugaccgucagcugcaaggccgacgaggacgaggacgacuucacggcguacgacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12081 - RNA, 390 nt, Artificial Sequence
  derived and/or modified sequence opt1 from anti-HIV_Chain
caggugcagcugguccagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12082 - RNA, 390 nt, Artificial Sequence
  derived and/or modified sequence opt1 from anti-HIV_Chain
caggugcagcugguccagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacucccggggccgcgggaccagccucaccguguccagcgcguccaccaagggc

SEQ ID NO: 12083 - RNA, 390 nt, Artificial Sequence
  derived and/or modified sequence opt1 from anti-HIV_Chain
gaggugcagcuggucgagagcggcuccgacgugcgcaagcccggggccaccgugaccgucagcugcaaggccgacgaggacgaggacgacuucacggcguacaacuacuucaugcacugggugcggcaggccccgggccaggggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12084 - RNA, 390 nt, Artificial Sequence
  derived and/or modified sequence opt1 from anti-HIV_Chain
gugguccagcuggugcagagcggcuccgacgugcgcaagcccggggccaccgucaccgugagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggucacccugacccgcgagcgguccacgagcaccguguucaugaagcugaccaaccuccgccuggacgacaccgccguguacuucugcgcccggccccugcgcggcggggacacguggcacuaccacuccuggggccgggggaccagccucaccgucuccagcgcguccaccaagggc

SEQ ID NO: 12085 - RNA, 390 nt, Artificial Sequence
  derived and/or modified sequence opt1 from anti-HIV_Chain
gaggugcagcugguccagagcggcuccgacgugcgcaagcccggggccaccgugaccgucagcugcaaggccgacgaggacgaggacgacuucacggcguacaacuacuucaugcacugggugcggcaggccccgggccacgggcucgaguggaucggcuggaucaacccccgcaccgggcagcccaaccacgccaagcaguuccagggccgggugacccugacccgcgagcgguccacgagcaccgucuucaugaagcugaccaaccuccgccuggacgacaccgccguguacuucugcgcccggccccugcgcggcggggacacguggcacuaccacuccuggggccgggggaccagccucaccguguccagcgcguccaccaagggc

SEQ ID NO: 12086 - RNA, 390 nt, Artificial Sequence
  derived and/or modified sequence opt1 from anti-HIV_Chain
gaggugcagcugguccagagcggcuccgacgugaagaagcccgggaccaccgugacgaucagcugcaaggccgacgaggacgaggacgacuucaccgccuacaacuacuucaugcacuggguccgccaggcgccgggccaggggcucgaguggaucggcuggaucaacccccggaccgggcagcccaaccacgccaagcagcugcagggccgcgugacccugacgcgggagcgcuccaccagcaccguguucaugaagcucaccaaccugcggcuggacgacacggccgucuacuucugcgcccgcccccuccggggcggggacaccuggcacuaccacuccuggggccgcgggaccagccugaucguguccagcgccuccaccaagggc

SEQ ID NO: 12087 - RNA, 390 nt, Artificial Sequence
  derived and/or modified sequence opt1 from anti-HIV_Chain
caggugcagcuggucgagagcggcgggggccucgugaagcccgggggcucccugcgccugagcugcgccgccuccggguucagcuucaacgaguacuacauguccuggauccggcaggcgccgggccagggccucgaguggguggccaacaucgggagcuccgacgccuacaccaucuacgccgacagcgucaagggccgcuucaccaucucccgggacaacgccgagaacacgguguaccugcagaugaacagccugcgcggggaggacaccgcgguguacuacugcgcccggaucgagggcuacugcuccaacagccgcugcuccaacuacuucgaccccugggggcagggcgcccucgucaccgugagcuccgccagcaccaagggc

SEQ ID NO: 12088 - RNA, 390 nt, Artificial Sequence
  derived and/or modified sequence opt1 from anti-HIV_Chain
caggugcagcugguccagagcggcgccgaggugaagaagcccggggccuccgugaaggucagcugcaagguguccggcuacccgcucgcggagcugagcgugcacuggguccgccaggugcccgggaagggccuggagugggucgggggcuucgaccccgaggagggcaagaccguguacgcccagaaguuccaggggcgggugaccaugacggaggaccgcuccaccgacaccguguacauggagcucaucagccugcgguacgaggacaccgccgucuacuacugcgccacggacaaccccgugcugcagcucggcgagcuguccagcucccuggacuacugggggcagggcacccucgugaccgucagcuccgccagcaccaagggg

SEQ ID NO: 12089 - RNA, 390 nt, Artificial Sequence
  derived and/or modified sequence opt1 from anti-HIV_Chain
gaggugcagcugguccagagcggcgccgaggugaagaagcccggggagucccuccgcaucagcugcaagaccuccggcuacaacuucaacgacgacuggaucgccugggugcggcagcgcccggacaaggggcccgaguggaugggcaucuucuaccccggggacagccaggcgaccuacucccccagcuuccagggccacgucacguucuccgccgacaccagcaucuccaccgccuaccugcaguggaccagccugaaggccuccgacacggccaucuacuacugcgcgcggacccgcugcuucggcgccaacugcuucaacuucauggacgugugggggaagggcaccgcccucaccgugacggucagcuccgccagcaccaagggg

SEQ ID NO: 12090 - RNA, 390 nt, Artificial Sequence
  derived and/or modified sequence opt1 from anti-HIV_Chain
caggugcagcugguccagcuccugcagagcggcgccgaggugaagaagcccggguccagcgugaaggucuccugccagaucagcggcuacggguucuccaacuacgccaucagcugggugcgccaggcgccgggccaggggcuggaguggcucggccggaucgugcccgccgucggcaugaccgaguacgcccagaaguuccaggggcgcgugaccuucacggccgaccgguccaccaucaccgccuacauggaccugcgcggccugcggagcgacgacaccgcgguguacuacugcguccgcgacccccagguggaggugcgggggaacgccuucgacaucuggggccaggggacgauggucaccguguccagcgccuccaccaagggc

SEQ ID NO: 12091 - RNA, 390 nt, Artificial Sequence
  derived and/or modified sequence opt1 from anti-HIV_Chain
caggugcaccuccagcaguggggcgccgggcuccugaagcccagcgagacccugucccugaccugcgccgucagcggcggguccuucagcggcuucuucuggacguggauccgccaguccccggggaagggccuggaguggaucggcgaggugaaccacagcggguucacccacuccaaccccagccuggagucccgggcgaccaucagcguggccgccuccaacacccaguucagccuccgccuggccuccgucacggccgcggacaccgccaucuacuucugcgcccugcgguacuucgacuggagccccuuccgccgggacaccuacggcaccgacgugugggggcagggcacgaccgugaucgucuccagcgccuccaccaagggg

SEQ ID NO: 12092 - RNA, 390 nt, Artificial Sequence
  derived and/or modified sequence opt1 from anti-HIV_Chain
caggugcgccuggagcagagcggcggggcccuccggaagcccggcgccuccgucacccugagcugccaggcguccggguacaacuucgugaaguacaucauccacugggugcgccagcggccgggccugggguucgagugggucggcaugaucgaccccuaccgcggccggcccugguacgcccacagcuucgccgggcgccucucccugagccgggacaccuccacggagacccuguacaugacccucagcucccucaagagcgacgacaccgccacguacuucugcgcccgcgcggaggccgccuccgacagccacucccggcccaucauggacuggaccuggcgcauccugugccugcuggccguggugccggcgagcaccaagggc

SEQ ID NO: 12093 - RNA, 390 nt, Artificial Sequence
  derived and/or modified sequence opt1 from anti-HIV_Chain
caggugcgccuggagcagagcggcgccgccguccggaagcccggggcguccgugacccucagcugccaggccuccggcuacaacuucgugaacuacaucauccacuggguccgccagcggccggggcuggacuucgagugggugggcaugaucgaccccuaccgcgggcggcccuggagcgcccacaaguuccagggccgccugucccucagccgggacguguccaccgagauccuguacaugacgcugaacagccuccgcuccgacgacaccgccaccuacuucugcgcccgggcggaggccgagagccagucccacagccgccccaucauguucgacuccuggggccaggggagccgggucaccguguccagcgccuccacgaagggc

SEQ ID NO: 12094 - RNA, 390 nt, Artificial Sequence
  derived and/or modified sequence opt1 from anti-HIV_Chain
caggugcgccuggagcagagcggcgccgccgucaagaagcccggggcguccgugaccaucagcugccaggccuccggcuacaacuucgugaaguucuucauccacuggguccggcagcgcccggggcagggcuucgaguggguggggaugaucgagcccuaccggggccgccccuggagcgccggcaacuuccaggggcggcucucccugagccgcgacguguccaccgagacgcuguacaugacccucaacaaccugcggagcgacgacaccgccgucuacuucugcgcccgccuggaggcggaguccgacagccacucccggcccaucauguucgaccacuggggccacgggagccucgugaccguguccagcgccuccacgaagggc

SEQ ID NO: 12095 - RNA, 390 nt, Artificial Sequence
  derived and/or modified sequence opt1 from anti-HIV_Chain
caggugcgccuggagcagagcggcgccgccguccggaagcccggggcguccgugacccucagcugccaggccuccggcuacaacuucgugaacuacaucauccacuggguccgccagcggccggggcuggacuucgagugggugggcaugaucgaccccuaccgcgggcggcccuggagcgcccacaaguucgagggccgccugucccucagccgggacguguccaccgagguccuguacaugacgcugagcucccuccgcagcgacgacaccgccaccuacuucugcgcccgggcggaggccgagucccagagccacucccgccccaucauguucgacuacuggggccaggggagccgggugaccguguccagcgccuccacgaagggc

SEQ ID NO: 12096 - RNA, 390 nt, Artificial Sequence
  derived and/or modified sequence opt1 from anti-HIV_Chain
caggugcgccuggagcagagcggcaccgccguccggaagcccggggccuccgugaccaucagcugccaggcguccggcuacaacuucgugaaguucuucauccacgggguccgccagcggccgggccagggguucgagugggugggcaugaucgagcccuuccgcggccggcccuggagcgccgggaacuuccagggccgccucucccugagccgggacguguccacggagacccuguacaugacccucaacaaccugcgcagcgacgacaccgccgucuacuucugcgcccggcuggaggccgaguccgacagccacucccgccccaucauguucgaccacugggggcacggcagccucgugacgguguccagcgcguccaccaagggg

SEQ ID NO: 12097 - RNA, 390 nt, Artificial Sequence
  derived and/or modified sequence opt1 from anti-HIV_Chain
caggugcgccuggagcagagcggcaccgccaugcggaagcccggggccuccgucacccucagcugccaggcguccggcuacaacuucgugaaguacaucgugcacuggguccgccagaagccggggcugggcuucgaguggguggggaugaucgaccccuaccggggccgccccuggagcgcccacaaguuccagggccggcugucccucagccgcgacacguccauggagauccuguacaugacccugaccagccucaaguccgacgacaccgccacguacuucugcgcccgggccgaggcggccagcgacucccacagccgccccaucauguucgaccacugggggcagggcucccgggugaccgucagcuccgccagcaccaagggg

SEQ ID NO: 12098 - RNA, 390 nt, Artificial Sequence
  derived and/or modified sequence opt1 from anti-HIV_Chain
caggugcgccuggagcagagcggcgccgccaugcggaagcccggggcguccgucacccucagcugccaggccuccggcuacaacuucgugaaguacaucgugcacuggguccgccagaagccggggcugggcuucgaguggguggggaugaucgaccccuaccggggccgccccuggagcgcccacaaguuccagggccggcugucccucagccgcgacaccuccauggagauccuguacaugacgcugaccagccucaaguccgacgacaccgccaccuacuucugcgcccgggcggaggccgccagcgacucccacagccgccccaucauguucgaccacugggggcagggcucccgggugacggucagcuccgccagcaccaagggg

SEQ ID NO: 12099 - RNA, 390 nt, Artificial Sequence
  derived and/or modified sequence opt1 from anti-HIV_Chain
caggugcgccuggagcagagcggcgccgccaugcggaagcccggggcguccgucacccucagcugccaggccuccggcuacaacuucgugaaguacaucauccacugggugcgccagaagccggggcugggcuucgagugggucgggaugaucgaccccuaccggggccgccccuggagcgcccacaaguuccagggccggcugucccucagccgcgacaccuccauggagauccuguacaugacgcugaccagccucaaguccgacgacaccgccaccuacuucugcgcccgggcggaggccgccagcgacucccacagccgccccaucauguucgaccacugggggcagggcucccgggugacggugagcuccgccagcaccaagggg

SEQ ID NO: 12100 - RNA, 390 nt, Artificial Sequence
  derived and/or modified sequence opt1 from anti-HIV_Chain
caggugcgccuggagcagagcggcaacgccguccggaagcccggggccuccgugaccaucagcugccaggcguccggcuacaacuucgugaaguucuucauccacuggguccgccagcggccggggcagggcuucgaguggguggggaugaucgagcccuuccgcggccggcccuggagcgccggcaacuuccaggggcgccucucccugagccgggacguguccaccgagacgcuguacaugacccucaacaaccugcgcagcgacgacaccgccgucuacuucugcgcccggcuggaggccgaguccgacagccacucccgccccaucauguucgaccacuggggccacgggagccucgugaccguguccagcgcguccacgaagggc

SEQ ID NO: 12101 - RNA, 390 nt, Artificial Sequence
  derived and/or modified sequence opt1 from anti-HIV_Chain
caggugcgccuggagcagagcggcgccgccguccggaagcccggggcguccgugacccucagcugccaggccuccggcuacaacuucgugcgcuacaucauccacuggguccggcagcgcccggggcuggacuucgagugggugggcaugaucgaccccuaccgggggcgccccuggagcgcccacaaguucggcggccggcugucccucacccgcgacgugagcacggagauccuguacaugacccugaccucccuccggagcgacgacaccgccacguacuucugcgcccgcgcggaggccgagucccagagccacucccggcccaucauguucgacagcugggggcagggcucccgcgucaccgugagcuccgccagcaccaagggg

SEQ ID NO: 12102 - RNA, 390 nt, Artificial Sequence
  derived and/or modified sequence opt1 from anti-HIV_Chain
caggugcgccuggagcagagcggcgccgccguccggaagcccggggcguccgugacccucagcugccaggccuccggcuacaacuucgugaacuacaucauccacuggguccgccagcggccggggcuggacuucgagugggugggcaugaucgaccccuaccgcgggcggcccuggagcgcccacaaguuccagggccgccugucccucagccgggacguguccaccgagauccuguacaugacgcugagcucccuccgcagcgacgacaccgccaccuacuucugcgcccgggcggaggccgagucccagagccacucccgccccaucauguucgacuucuggggccaggggagccgggucaccguguccagcgccuccacgaagggc

SEQ ID NO: 12103 - RNA, 390 nt, Artificial Sequence
  derived and/or modified sequence opt1 from anti-HIV_Chain
caggugcgccuggagcagagcggcaccgccguccggaagcccggggccuccgugaccaucagcugccaggcguccggcuacaacuucgugaaguucuucauccacuggguccgccagcggccggggcagggcuucgaguggguggggaugaucgagcccuuccgcggccggcccuggagcgccggcaacuuccaggggcgccucucccugagccgggacguguccacggagacccuguacaugacccucaacaaccugcgcagcgacgacaccgccgucuacuucugcgcccggcuggaggccgaguccgacagccacucccgccccaucauguucgaccacuggggccacgggagccucgugacgguguccagcgcguccaccaagggc

SEQ ID NO: 12104 - RNA, 390 nt, Artificial Sequence
  derived and/or modified sequence opt1 from anti-HIV_Chain
caggugcgccuggagcagagcggcgccgccaugcggaagcccggggcguccgucacccucagcugccaggccuccggcuacaacuucgugaaguacaucgugcacuggguccgccagaagccggggcugggcuucgaguggguggggaugaucgaccccuaccggggccgccccuggagcgcccacaaguuccagggccggcugucccucagccgcgacaccuccauggagauccuguacaugacgcugaccagccucaccuccgacgacaccgccacguacuucugcgcccgggcggaggccgccagcgacucccacagccgccccaucauguucgaccacugggggcagggcucccgggugaccgucagcuccgccagcaccaagggg

SEQ ID NO: 12105 - RNA, 390 nt, Artificial Sequence
  derived and/or modified sequence opt1 from anti-HIV_Chain
gaggugcagcugguccagagcggcgggggccucgugcagcccgggggcucccugcggcugagcugcgccgccuccgggcucaccuuccggaacuucgcgaugagcugggugcgccaggccccgggcaagggccuggagugggucuccagcaucuccgggagcggcggguccaccuacuacgccgacagcgugaagggccgguucacgaucucccgcgacaacagcaagaacacccuguaccuccagaugaacucccugcgcggggaggacaccgccguguacuucugcgccaagggcgucggcuacgacauccugaccgggcucggcgacgcguucgacaucugggggcagggcacggugguggccgucagcuccgccagcaccaagggc

SEQ ID NO: 12106 - RNA, 393 nt, Artificial Sequence
  derived and/or modified sequence opt1 from anti-HIV_Chain
caggugcagcugguccagagcggcgccgccgugcgcaagcccggggcguccgugaccgucagcugcaaguucgccgaggacgacgacuacuccccgcacugggugaaccccgcccccgagcacuacauccacuuccuccggcaggcccccggccagcagcuggaguggcuggccuggaugaacccgaccaacggggcggugaacuacgccuggcagcuccacggccgccugacggccacccgggacgggagcaugaccaccgccuuccuggagguccgcucccuccggagcgacgacacggcgguguacuacugcgcccgcgcccagaagcggggccgcuccgagugggccuacgcccacuggggccaggggacccccgugcuggucagcucc

SEQ ID NO: 12107 - RNA, 393 nt, Artificial Sequence
  derived and/or modified sequence opt1 from anti-HIV_Chain
caggugcagcugcagcaguggggcgccgggcuccugaagcccagcgagacccugucccugaccugcgccgucuacgcgggcagcuucuccggguacuacuggacguggauccgccagccgcccggcaaggggcuggaguggaucggcgaggugaaccacggcgggagcaccaacuacaaccccucccucaagagccgggugacccucuccgucgacaccagcaagaaccaguucucccugaagcugacgagcgugaccgccgccgacaccgccguguacuacugcgcccgcgucucccgguacgacuucuggagcggcaacuacggguccuacggccucgacgugugggggcagggcaccacggugaccgucagcuccgcgagcaccaagggc

SEQ ID NO: 12108 - RNA, 393 nt, Artificial Sequence
  derived and/or modified sequence opt1 from anti-HIV_Chain
gaggugcagcugguccagagcggcgggggcguggugcagcccgggcgcucccuccggcugagcugcgucguguccggcuucaccuucagcuccuucaccuuccacugggugcgccaggccccggggaagggccuggagugggucgccggcaugagcuuccacgcgacguacaucuacuacgccgacuccgugaaggggcgguucaccaucagccgcgacgacucccaggacacccucuaccuggagauggacagccugcgguccgaggacaccgccaucuacuacugcgcccgcgaccccggcauccacgacuacggggacuacgcccccggcgcguucgacuacugggggcagggcagccccgugacggucuccagcgccuccaccaagggc

SEQ ID NO: 12109 - RNA, 393 nt, Artificial Sequence
  derived and/or modified sequence opt1 from anti-HIV_Chain
caggugcagcugguccagagcggcaccgaggugcagaagcccggggccuccgugaaggucagcugcaagaccuccggcuacacguucagcaaguacuacauccacugggugcgccaggcccccgggcagggccucgaguggguggggcggaucaacaccgacuccggcggcaccgacuacgcggagaaguuccaggggcgcgucaccaugacgcgggacaccagcaucaccaccguguaccuggagaugcgcggccugacguccgacgacaccgccgccuucuacugcgcccgggggccgccccacgccggcggguggaccaucuacuacuacggccucgacguguggggccaggggaccagcgucaucguguccagcgcguccacgaagggc

SEQ ID NO: 12110 - RNA, 393 nt, Artificial Sequence
  derived and/or modified sequence opt1 from anti-HIV_Chain
cgcaccguggucacccagcccccgagcguguccggcgcccccgggcagcgggugacgaucagcugcaccggcuccagcuccaacaucggggccggcuacgacguccacugguaccagcagcugcccgggaccgcgcccaagcuccugaucuacggcaacagcaaccgcccguccggcgugcccgaccgguucagcggguccaagagcggcaccuccgccagccuggccaucacggggcuccaggccgaggacgaggccgacuacuacugccaguccuacgacagcucccugagcggcuccgggguguucggcaccggcaccaaggucaccgugcuggggcagcccaaggcgaaccccacggugacccucuucccgcccagcuccgaggagcug

SEQ ID NO: 12111 - RNA, 393 nt, Artificial Sequence
  derived and/or modified sequence opt1 from anti-HIV_Chain
caggugcagcugcagcaguggggcagcgggcuccugaagcccuccgagacccugagccugaccugcgccgucuacggcggguccuuccgcagcuacuacuggaacuggauccggcaguccccgggcaaggggcucgaguggaucggcgaggugagccacuccggcagcacgaacuacaaccccgcccugaagucccgcgugaccaucagcgucgacaccuccaagaaccaguucagccucaaggugaaguccgugaccgcggccgacacggcccuguacuacugcagccgggggcgcggcaagcggugcuccggggccuacugcuucgccggcuacuucgacagcugggggcagggcggccuggucgugguguccagcgcguccaccaagggg

SEQ ID NO: 12112 - RNA, 393 nt, Artificial Sequence
  derived and/or modified sequence opt1 from anti-HIV_Chain
caggugcaccugguccagagcggcgccgaggugaagaagcccggguccagcgugcgcgucuccugcgaggccagcggcuggaccuucggguccgugaacagcgcgaucaccugggugcggcaggccccgggccaggggcucgaguggaugggccgcacgauccccuuccugggcaucuccaacuacgcccagaaguuccaggggcgggucaccaucaccgccgacaagagcaccaacaucgccuacguggacgugacgucccugaccagccaggacaccgcggucuacuacugcgcccgccucaucaccggcaugacggcccccugguucuacuacauggacgugugggggaagggcaccaccgugaccgucuccagcgccuccacgaagggg

SEQ ID NO: 12113 - RNA, 393 nt, Artificial Sequence
  derived and/or modified sequence opt1 from anti-HIV_Chain
caggugcaccuccaggagagcggcccccgccugguccgguccagcgagacccugucccugaccugcagcgugcccgggggcuccaucgugaaccccaucacgaacuacuacuggagcuggauccgccaguccccgcggaaggggcuccaguggaucggcgacaucuacuacaccgggaccagcucccgcaaccccagccuggacucccgggucagcaucuccauggacgugagccgcaagcagaucucccugacccucuacagcgugacggccgccgacaccgcgguccacuacugcgccucccagagccuguccugguaccggccgagcggcuacuucgagagcuggggccaggggauccuggugaccguguccagcgccuccaccaagggc

SEQ ID NO: 12114 - RNA, 393 nt, Artificial Sequence
  derived and/or modified sequence opt1 from anti-HIV_LightChain
augaagcugcccgugcgccuccugguccugauguucuggaucccggccagcuccagcgacaucgugaugacccagagcccccucucccugcccgugacccccggcgagccggccuccaucagcugccgguccagccagcgccugcucuccagcuacgggcacacguaccugcacugguaccugcagaagcccggccagagcccccagcuccugaucuacgaggucuccaaccgguucuccggggugcccgaccgcuucagcggcuccgggagcggcaccgacuucacccugaagaucucccggguggaggcggaggacgucggcguguacuacugcagccaguccacccacgugccgcucacguucgggcagggcaccaaggucgagaucaag

SEQ ID NO: 12115 - RNA, 396 nt, Artificial Sequence
  derived and/or modified sequence opt1 from anti-HIV_Chain
caggugcagcugcaggagagcggccccgggcucgucaagccguccgagacccugagcgugaccugcuccgugagcggcgacuccaugaacaacuacuacuggacguggauccgccagagccccgggaagggccuggaguggaucggguacaucuccgaccgggccagcgccaccuacaaccccucccucaacagccgcgucgugaucucccgggacaccagcaagaaccagcugucccugaagcucaacagcgugacccccgcggacacggccgucuacuacugcgccaccgcccgccggggccagcgcaucuacggcgugguguccuucggggaguucuucuacuacuacagcauggacgucuggggcaaggggaccaccgugacgguguccagc

SEQ ID NO: 12116 - RNA, 396 nt, Artificial Sequence
  derived and/or modified sequence opt1 from anti-HIV_Chain
caggugcagcugcaggagagcggccccgggcucgucaagccgcccgagacccugucccugaccugcagcguguccggcgccagcgugaacgacgccuacugguccuggauccgccagagccccgggaagcggcccgagugggucggcuacgugcaccacuccggggacacgaacuacaacccgagccucaagcgccgggugaccuucucccuggacaccgcgaagaacgaggucagccugaagcucguggcccugaccgccgccgacuccgccguguacuucugcgcgcgcgcccugcacggcaagcggaucuacggcaucgucgcccucggggagcuguucacguacuucuacauggacguguggggcaaggggaccaccgugaccgucagcucc

SEQ ID NO: 12117 - RNA, 396 nt, Artificial Sequence
  derived and/or modified sequence opt1 from anti-HIV_Chain
caggugcagcugcaggagagcggccccgggcucgucaagccguccgagacccugagccugaccugcuccgugagcggcgccuccaucagcgacuccuacuggagcuggauccgccggucccccgggaagggccucgaguggaucggguacgugcacaagagcggcgacacgaacuacucccccagccugaagucccgcgucaaccugagccucgacaccuccaagaaccaggugagccugucccugguggccgcgaccgccgccgacagcggcaaguacuacugcgcccggacccuccacgggcgccggaucuacggcaucgucgccuucaacgagugguucacguacuucuacauggacgugugggggaacggcacccaggugaccgucuccagc

SEQ ID NO: 12118 - RNA, 396 nt, Artificial Sequence
  derived and/or modified sequence opt1 from anti-HIV_Chain
caggugcaccuccaggagagcggccccgggcuggucaagccguccgagacccugagccugaccugcaacguguccggcacgcucgugcgcgacaacuacuggagcuggaugcggcagccccuggggaagcagcccgaguggaucggcuacguccacgacuccggggacaccaacuacaaccccagccugaagucccgcgugcaccucagccuggacaaguccaacaaccuggugagccuccggcugaccgccgucaccgccgcggacuccgccacguacuacugcgccaccaccaagcacggccgccggaucuacggcaucguggccuucaacgagugguucaccuacuucuacauggacgugugggggaagggcacgaccgucaccgugagcucc

SEQ ID NO: 12119 - RNA, 396 nt, Artificial Sequence
  derived and/or modified sequence opt1 from anti-HIV_Chain
caggugcagcugcaggagagcggccccgggcucgucaagccguccgagacccugagcgugaccugcuccgugagcggcgacuccaugaacaacuacuacuggacguggauccgccagagccccgggaagggccuggaguggaucggguacaucuccgaccgggagagcgccaccuacaaccccucccucaacagccgcgucgugaucucccgggacaccagcaccaaccagcugucccugaagcucaacagcgugacgcccgccgacaccgcggucuacuacugcgccaccgcccgccggggccagcgcaucuacggcgugguguccuucggggaguucuucuacuacuacagcauggacgucuggggccgggggaccacggugaccguguccagc

SEQ ID NO: 12120 - RNA, 396 nt, Artificial Sequence
  derived and/or modified sequence opt1 from anti-HIV_Chain
caggugcagcuggucgagagcggccccgggcuggugaccccguccgagacccugagccugacgugcaccguguccaacggcagcgucuccgggcgcuucuggagcuggauccggcagucccccggccgcgggcucgaguggaucggcuacuucagcgacaccgaccgguccgaguacagccccucccugcgcagccggcugacccucucccuggacgccagccgcaaccagcugucccucaagcucaagagcgugacggccgcggacuccgccaccuacuacugcgcccgggcccagcagggcaagcgcaucuacgggaucgugagcuucggcgaguucuucuacuacuacuacauggacgccugggggaagggcaccgcggucaccguguccagc

SEQ ID NO: 12121 - RNA, 396 nt, Artificial Sequence
  derived and/or modified sequence opt1 from anti-HIV_Chain
caggugcagcugcaggagagcggccccgggcucgucaagccgcccgagacccugucccugaccugcagcguguccggcgccagcaucaacgacgccuacugguccuggauccgccagagccccgggaagcggcccgagugggugggcuacguccaccacuccggggacacgaacuacaacccgagccucaagcgccgggugaccuucucccuggacaccgcgaagaacgaggugagccugaagcucgucgaccugaccgccgccgacuccgccguguacuucugcgcccgcgcgcugcacggcaagcggaucuacggcaucguggcccucggggagcuguucacguacuucuacauggacgucuggggcaaggggaccaccgugaccgugagcucc

SEQ ID NO: 12122 - RNA, 396 nt, Artificial Sequence
  derived and/or modified sequence opt1 from anti-HIV_Chain
caggugcagcugcaggagagcggccccgggcucgucaagccgcccgagacccugucccugaccugcagcguguccggcgccagcaucaacgacgccuacugguccuggauccgccagagccccgggaagcggcccgagugggugggcuacguccaccacuccggggacacgaacuacaacccgagccucaagcgccggguguccuucagccuggacaccgcgaagaacgaggugucccugaagcucgucgaccugaccgccgccgacagcgccaucuacuucugcgcccgcgcgcugcacggcaagcggaucuacggcaucguggcccucggggagcuguucaccuacuucuacauggacguguggggcaaggggacgaccgucaccguguccagc

SEQ ID NO: 12123 - RNA, 396 nt, Artificial Sequence
  derived and/or modified sequence opt1 from anti-HIV_Chain
caggugcagcugcaggagagcggccccgggcucgucaagccguccgagacccugagcgugaccugcuccgugagcggcgacuccaugaacaacagcuacuggacguggauccgccagucccccgggaagggccuggaguggaucggguacaucagcaaguccgagagcgccaacuacaaccccucccucaacagccgggucgugaucucccgcgacaccagcaagaaccagcugucccugaagcucaacagcgugacccccgccgacaccgcggucuacuacugcgccacggcccggcacggccagcgcaucuacggcgugguguccuucggggaguucuucaccuacuacagcauggacgucuggggcaaggggaccaccgugacgguguccagc

SEQ ID NO: 12124 - RNA, 396 nt, Artificial Sequence
  derived and/or modified sequence opt1 from anti-HIV_Chain
caggugcagcugcaggagagcggccccgggcucgucaagccguccgagacccugagccugaccugcuccgugagcaacggcuccgugagcgggcgcuucugguccuggauccggcagagccccggccgcgggcucgaguggaucggcuacuucuccgacacggagaaguccaacuacaaccccagccugcggagccgccugacccucuccgucgacgccagcaagaaccagcugucccugaagcucaacagcgugaccgccgcggacuccgccaccuacuacugcgcccggacgcagcagggcaagcgcaucuacgggguggucagcuucggcgaguucuuccacuacuacuacauggacgccugggggaagggcaccgccgugaccguguccagc

SEQ ID NO: 12125 - RNA, 396 nt, Artificial Sequence
  derived and/or modified sequence opt1 from anti-HIV_Chain
caggugcagcugguccagagcggcaccgcccucaagucccccgggagcuccgccaagcugagcugcaccgugcugggcgacgaguucgggacguacuucaucuccuggauccgccaggcgccgggccaggggcucgagugggugggcggcaucgucccccacagccagcugcaguccagcgcccagaaguuccacgggcggaucaucaucuccgccggcgccggggugaccccgcccguggucagccugcagcucaccaaccugaccuucgaggacacgggcaccuacuucugcgcccgcgagcgggggcgccaccgggaccccaagaccggcgacgcgcugcgcggccgguacuucgacuucugggggcgcggcaccgggguguccgugagcgcc

SEQ ID NO: 12126 - RNA, 396 nt, Artificial Sequence
  derived and/or modified sequence opt1 from anti-HIV_Chain
caggugcagcugguccagagcggcaccgcccucaagucccccgggagcuccgccaagcugagcugcaccgugcugggcgacgaguucgggacguacuucaucuccuggauccgccaggcgccgggccaggggcucgagugggugggcggcaucgucccccacagccagcugcaguccagcgcccagaaguuccacgggcggaucaucaucuccgccggcgccggggugaccccgcccguggucagccugcagcucaccaaccugaccuucgaggacacgggcaccuacuucugcgcccgcgagcgggggcgccaccgggaccccaagaccggcaaggcgccccgcggccgguacuucgacuucugggggcgcggcaccggggugacgguguccgcc

SEQ ID NO: 12127 - RNA, 396 nt, Artificial Sequence
  derived and/or modified sequence opt1 from anti-HIV_Chain
caggugcagcugguccagagcggcaccgcccucaagucccccgggagcuccgccaagcugagcugcaccgugcugggcgacgaguucgggacguacuucaucuccuggauccgccaggcgccgggccaggggcucgagugggugggcggcaucgucccccacagccagcugcaguccagcgcccagaaguuccacgggcggaucaccaucuccgccggcgccggggugaccccgcccguggucagccugcagcucaccaaccugacguucgaggacaccggcaccuacuucugcgcccgcgagcgggggcgccaccgggaccccaagaccggcgacgcgcugcgcggccgguacuucgacuucugggggcgcggcacgggggugcggguguccacc

SEQ ID NO: 12128 - RNA, 396 nt, Artificial Sequence
  derived and/or modified sequence opt1 from anti-HIV_Chain
caggugcagcugguccagagcggcgccgccgugaagucccccgggagcuccgcgaagcucagcugcaccgugcugggcgacgaguucgggaccuacuucaucuccuggauccgccaggccccgggccaggggcuggagugggucggcggcaucgugccccacagccagcuccaguccagcgcccagcgguuccacgggcgcaucacgaucuccgccggcgccggggugaccccgcccgucgugagccugcagcugaccaaccucaccuucgacgacgcgggcacguacuucugcgcccgggagcgcgggcggcaccgcgaccccaagaccggcgacgcccugcggggccgcuacuucgacuucugggggcggggcaccgggaucuccgugagcccc

SEQ ID NO: 12129 - RNA, 396 nt, Artificial Sequence
  derived and/or modified sequence opt1 from anti-HIV_Chain
gaggugcagcugguccagagcggcgccgaggugaagaagcccggggccuccgugaaggucagcugcaagguguccggcuacacccucaccgagcugagcauccacugggugcgccaggcgccggggaagggccuggaguggaugggcggguucgaccccgaggacgacgaggccaucuacgagcccaaguuccagggccggcucacgaugaccgaggacaccuccaccgacacggccuacauggagcugagcucccugcgcagcgaggacaccgccgucuacuacugcgccaccgcggaccccuucaagguggcccaggacgaggggcucuacgugaucuucgacuacuggggccaggggacccuggucacgguguccagcgccuccaccaagggc

SEQ ID NO: 12130 - RNA, 396 nt, Artificial Sequence
  derived and/or modified sequence opt1 from anti-HIV_Chain
gaggugcagcuggucgagagcggcgggggccuccugcagcccgggggcucccugcgccucagcugcgccgccuccggguucagcuucaacgacuucgagaugaacugggugcggcaggcgcccggcaagggccuggaguggguguccuacaucagcaacgacgggaccaugauccacuacgccgacuccgucaagggccgcuucaccaucagccgggacaacgccaagaagucccuguuccuccagaugaacagccugcgcgccgaggacacggccguguacuacugcgcgcggcuggccgaggugccgcccgccauccgcggguccuacuacuacggcauggacgucugggggcagggcaccaccgugaccguggccagcgcguccacgaagggc

SEQ ID NO: 12131 - RNA, 396 nt, Artificial Sequence
  derived and/or modified sequence opt1 from anti-HIV_Chain
caggugcagcugaugcagagcggcgccgaggucaagcgccccggggccuccgugaaggugagcugcaaggcguuccggcacucccucaacaaccugggcaucagcuggauccgccgggccccggggcgcggccuggaguggcucggguggaucaacgucuacgagggcaacaccaaguacggccggcgcuuccaggggcgggugaccaugacgaccgaccgcuccaccaacaccgugagcauggagcugcggucccugacgagcgacgacaccgccgucuacuacugcgcccgcgacaaccacuucugguccggcagcucccgguacuacuacuucgggauggacguguggggccaggggaccaccgugaucgucagcuccgccagcacgaagggc

SEQ ID NO: 12132 - RNA, 396 nt, Artificial Sequence
  derived and/or modified sequence opt1 from anti-HIV_Chain
caggugcagcugguccaguggggcgccgggcuccugaagccccuggagacccucagccugaccugcgccguguacggcggguccuucaacggcuacuucuggagcuggauccgccagacgccggggaagggccuggaguggaucggcgagaucaaccacgggggcuccgcgaacuucaaccccagccucaagucccgggugaccaugagcgucgacaccuccaagaaccaguucagccugaagcuggccuccgugaccgccgccgacacggccaucuacuacugcgcgcgcgggcggaucaccauggugcgcggcgacccccagcgcgggggcguccggauggacguguggggccaggggaccagcgugaccgucuccagcgccuccacgaagggc

SEQ ID NO: 12133 - RNA, 396 nt, Artificial Sequence
  derived and/or modified sequence opt1 from anti-HIV_Chain
cuggugcagcucguccagagcggcgccgaggugaagaagcccggggccuccgugaaggucagcugcaagguguccggccacacccugagcgagcuguccaucaacugggugcgccacgucccggggaagggccucgaguggaugggcgggcuggaccccgaggacggcgaggcgauccacgagcccaaguuccaggggcggcugaccaugacggaggacaccagcaccgacaccgccuacuccacgcucagcgugugggcccccguggccgccgcgauguacuacugcgccaccgccgacccguucaaggucgcccaggacgagggccuguacgugaucuucgacuacugggggcagggcacccuggugaccgucuccagcgcguccacgaagggg

SEQ ID NO: 12134 - RNA, 396 nt, Artificial Sequence
  derived and/or modified sequence opt1 from anti-HIV_Chain
caggugcagcugcuccagagcggcggggaggucaagaagcccggcgccuccgugaaggugagcugcaaggucuccggguacacccugaccgagcugagcauccacugggugcgccaggccccgggcaaggggcucgaguggaugggcggcuucgaccccgaggacgacgaggcgaucuacgagcccaaguuccaggggcggcugacgaugaccgaggacaccuccaccgacacggccuacauggagcugagcucccuccgcagcgaggacaccgccguguacuacugcgccaccgccgaccccuucaaggucgcgcaggacgagggccuguacgugaucuucgacuacugggggcagggcacccuggugacggucuccagcgccuccaccaagggg

SEQ ID NO: 12135 - RNA, 396 nt, Artificial Sequence
  derived and/or modified sequence opt1 from anti-HIV_Chain
caggugcagcugguccagagcggcgccgaggugaagaagcccggggccuccgugaaggucagcugcaagguguccggcuacacccucaccgagcugagcauccacugggugcgccaggcgccggggaagggccuggaguggaugggcggguucgacuccgaggacggcgaggccuucuacaagcagaacuuccaggggcgggucacgaugaccgaggacaccagcaccgacacggccuacauggagcuccgccggcugcgcuccgaggacaccgccguguacuacugcgccaccgcggaccgguucaagguggcccaggacgagggccuguucgucaucuucgacuacugggggcagggcacccucgugacggugagcuccgccagcaccaagggg

SEQ ID NO: 12136 - RNA, 396 nt, Artificial Sequence
  derived and/or modified sequence opt1 from anti-HIV_Chain
caggugcaccugguccagagcggcgccgaggugaagaagcccggggccuccgugcgggucagcugcaaggcguccggcuacaccuucaccacguacgggaucagcugggugcggcaggccccgggccaggggcucgaguggaugggcuggaucuccgcccacagcggcgacaccaacuacgcccagaagcugcaggcccgcgugaccaugaccacggacaccuccaccaacaccgcguacauggagcugcggagccucacguccgacgacaccgccgucuacuacugcgcccgcgaccggccccgccacuacuacgaccgcgggggcuacuacagccccuucgacuacugggggcagggcacccuggugaccguguccagcgccuccacgaagggg

SEQ ID NO: 12137 - RNA, 396 nt, Artificial Sequence
  derived and/or modified sequence opt1 from anti-HIV_Chain
cuggugcagcuccugcagagcggcgccgaggucaagaagcccggggccuccgugaaggugagcugcaaggucuccggcuacacccugaccgagcucagcauccacugggugcgccaggcgccggggaagggccuggaguggaugggcggguucgaccccgaggacgacgaggccaucuacgagcccaaguuccagggccggcugacgaugaccgaggacaccuccaccgacacggccuacauggagcucagcucccugcgcagcgaggacaccgccguguacuacugcgccaccgcggaccccuucaaggucgcccaggacgaggggcuguacgugaucuucgacuacuggggccaggggacccucgugacggucuccagcgccuccaccaagggc

SEQ ID NO: 12138 - RNA, 396 nt, Artificial Sequence
  derived and/or modified sequence opt1 from anti-HIV_Chain
caggugcagcugguccagagcggcgccgaggugaagaagcccggggccuccgugaaggucagcugcaagguguccggccacacccucagcgagcuguccaucaacugggugcgccacgucccggggaagggccuggaguggaugggcgggcucgaccccgaggacggcgaggcgauccacgagcccaaguuccaggggcggcugaccaugacggaggacaccagcaccgacaccgccuacguggagcuguccagccuccgcuccgaggacacggccauguacuacugcgccaccgccgaccccuucaagguggcgcaggacgagggccuguacgucaucuucgacuacugggggcagggcacccuggugaccgugagcuccgccagcacgaagggg

SEQ ID NO: 12139 - RNA, 396 nt, Artificial Sequence
  derived and/or modified sequence opt1 from anti-HIV_Chain
caggugcagcugcuccagagcggcgccgaggucaagaagcccggggccuccgugaaggugagcugcaaggucuccggcuacacccugaccgagcugagcaucaacugggugcgccaggcgccggggaagggccucgaguggaugggcggguucgaccccgaggacgacgaggccaucuacgagcccaaguuccagggccggcugacgaugaccgaggacaccuccaccgacacggccuacauggagcugagcucccuccgcagcgaggacaccgccguguacuacugcgccaccgcggaccccuucaaggucgcccaggacgaggggcuguacgugaucuucgacuacuggggccaggggacccuggugacggucuccagcgccuccaccaagggc

SEQ ID NO: 12140 - RNA, 396 nt, Artificial Sequence
  derived and/or modified sequence opt1 from anti-HIV_Chain
cagccccagcuggugcagagcggcuccggggccgaggucaagaagccgggcgccagcgugcgcaucuccugcgaggcgagcgaguacaacguguucgaccacuucaugcaguggguccggcaggcccccgggcagggccucgaguggaugggguggaucaacccccgcggcggcuaccccuccuacagcccgaccuuccaggggcggcugaccuucacgcgccagcccuccugggacgacagcaccaucaccuuccacauggagcugcggggccucgggcacgacgacaccgccguguacuacugcgcccgcccccacucccccgacgacgccuggagccuggacguguggggccgggggacgcuggucaccguguccagcgcguccaccaagggc

SEQ ID NO: 12141 - RNA, 396 nt, Artificial Sequence
  derived and/or modified sequence opt1 from anti-HIV_Chain
cagccccagcuggugcagagcggcuccggggccgaggucaagaagccgggcgccagcgugcgcaucuccugcgaggcgagcgaguacaacguguucgaccacuucaugcaguggguccggcaggcccccgggcagggccucgaguggaugggguggaucaacccccgcggcggcuaccccuccuacagcccgcgguuccaggggcgccugaccuucacccggcagcccuccugggacgacagcuccgugacguuccacauggagcugcgcggccuccggcacgacgacaccgccguguacuacugcgcccgcccccacagccccgacgacgccuggucccuggacgucugggggcggggcacccuggugaccgugagcuccgcgagcacgaagggg

SEQ ID NO: 12142 - RNA, 396 nt, Artificial Sequence
  derived and/or modified sequence opt1 from anti-HIV_Chain
gaggugcagcuggucgagagcggcgggggcgugguggagcccggggagucccuccgccugagcugcgccgccuccggcuucaccuuccggagcuacgacauguucuggguccgccaggcgaccgggaagucccuggagugggugagcgccaucggcaucgccggcgacacguacuacuccgggagcgugaagggccgguucaccaucucccgcgagaacgcccggaccagccucuaccugcagcuguccgggcuccgcgucgaggacagcgccguguacuucugcgugcggggcuccccgccccgcaucgcggccaccgaguacaacuacuacuacgggcuggacgucuggggccagggcacgaccgugagcguguucuccgccagcaccaagggg

SEQ ID NO: 12143 - RNA, 396 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggaccuucaccacguacgacaucuccugggugcgccaggcgccgggccaggggcucgaguggaugggcggcauccugcccgacuucggggcccccagcuacgcccagaaguuccaggaccgggugaccaucaccaccgacgaguccagcuccacggccuacauggagcugaacagccuccgcuccgaggacaccgccaucuacuacugcgcgcggggccgcggggacgacuucuggagcggcgagucccccagcugguacuucgacuacugggggcagggcacccuggucaccguguccagcgccuccacgaagggc

SEQ ID NO: 12144 - RNA, 396 nt, Artificial Sequence
  derived and/or modified sequence opt1 from anti-HIV_Chain
cagccccagcuggugcagagcggcuccggggccgaggucaagaagccgggcgccagcgugcgcaucuccugcgaggcgagcgaguacaacguguucgaccacuucaugcaguggguccggcaggcccccauggaggggcucgaguggaugggcuggaucaacccccgcgggggcuaccccuccuacagcccgaccuuccagggccggcugaccuucacgcgccagcccuccugggacgacagcaccaucaccuuccacauggagcugcgggggcuccgccacgacgacaccgccguguacuacugcgcccggccccacucccccgacgacgccuggagccuggacguguggggccgcgggacgcuggucaccguguccagcgcguccaccaagggc

SEQ ID NO: 12145 - RNA, 396 nt, Artificial Sequence
  derived and/or modified sequence opt1 from anti-HIV_Chain
gaggugcgccugcucgagagcggcgggggccugguccagcccgggggcucccugcggcucagcugcuccgccagcggguucaccuucuccaacagcgcccuguccugggugcgccaggcgccgggcaagggccuggagugggugagcuccgucgugagcuccgggggcgacaccuucuacgccgacagcgugaaggggcgguucacgaucucccgcgacaacagccggaacacccucuaccugcagaugaagucccugcgcgccgaggacaccgcccucuacuacugcgccaagguccagauccagcagcugaacuucggcgugaucaccgacgcggggauggacguguggggcaagggcacgaccgucaucgugagcuccgccagcaccaagggg

SEQ ID NO: 12146 - RNA, 396 nt, Artificial Sequence
  derived and/or modified sequence opt1 from anti-HIV_Chain
caggugcagcuggucgagagcggcgggggcguggugcagcccgggcgcucccuccggcugagcugcgucggcuccggguucaccuucagcuccagcggcaugcacugggugcgccaggcccccggcaaggggcuggaguggguggccgucaucuccagcgacggcuccgacgaguacuacggggacagcguggagggccgguucaccaucucccgcgacaacagcaagaacacccucuuccugcagcuggacucccucgaggcggaggacagcgccguguacuacugcgccaagacgccgccccacuacgacgcccugaccggguaccccuccagcguccuggaguucuggggccucggcacccuggugacgguguccagcgccuccaccaagggg

SEQ ID NO: 12147 - RNA, 396 nt, Artificial Sequence
  derived and/or modified sequence opt1 from anti-HIV_Chain
gaggugcagcugguccagagcggcgccgaggugaagaagcccggguccagcgugaaggucuccugcaaggccagcggcgggaccuucaccacguacgacaucuccugggugcggcaggcgccgggccaggggcucgaguggaucggcggcauccugcccgacuucggggcccccagcuacgcccagaaguuccaggaccgggugaccaucaccaccgacgaguccagccgcacggccuacauggagcugaacucccuccggagcgaggacaccgccaucuacuacugcgcgcgcggccgcggggacgacuucugguccggcgagagccccuccugguacuucgacuacugggggcagggcacccaggucaccgugagcuccgccagcacgaagggc

SEQ ID NO: 12148 - RNA, 396 nt, Artificial Sequence
  derived and/or modified sequence opt1 from anti-HIV_Chain
caggugcagcugcuccagagcggcaccgaggucaagaagcccggguccagcgugaagguguccugccgcgccagcggcuggacccuggggaacuccccgaacagcgccaucggcuggguccggcaggcgcccgggcagggccuggaguggaucggccgcaucauccccauccucgacgugacgaacuacgcccagaaguuccaggggcgggugaccaucuccgccgacaagagcaccaacaucgccuacauggagaucuccagccugggcuccgaggacaccgccuucuacuacugcgcgcgcgucaucacggggaugaccagccccugguacuucuacauggacguguggggcgaggggaccaccgugaucgucuccagcgccuccacgaagggc

SEQ ID NO: 12149 - RNA, 396 nt, Artificial Sequence
  derived and/or modified sequence opt1 from anti-HIV_Chain
caggugcaccugguccagagcggcgccgaggugaagaagcccggguccagcgugcgcgucuccugcaaggccagcggcuggaccuucggggacuccgugaacagcgcgaucaccugggugcggcaggccccgggccaggggcucgaguggaugggccgcuucauccccauccugggccuguccaacuacgcccagaaguuccaggaccgggucacgaucaacguggaccgcagcaccaacaccgccuacauggagcucuccgggcugcggagcgaggacaccgccguguacuacugcgcgcgccugaucacgggcaugaacgcccccugguucuacuacauggacgucugggggaagggcaccaccaucaccguguccagcgccuccacgaagggg

SEQ ID NO: 12150 - RNA, 396 nt, Artificial Sequence
  derived and/or modified sequence opt1 from anti-HIV_Chain
caggugcaccugguccagagcggcgccgaggccaagcgccccggguccagcgugcggguguccugccgcgcgagcggcggggacuucuccagcuacacccucuccuggguccggcaggcccccggccaggggcuggagcgcaugggcggcguggugcccaugcuggacaccguccacuacgcccagaaguuccaggggcggcucacgcugagcguggacgagggcaccuccaccgccuacauggagcugagcucccuccgcagcgaggacaccgccauguacuacugcacgcgggggcgccagaccuuccgggcgaucugguccggcccgcccguggucuucgacaucugggggcagggcacccuggugagcguguccagcgccuccaccaagggc

SEQ ID NO: 12151 - RNA, 396 nt, Artificial Sequence
  derived and/or modified sequence opt1 from anti-HIV_Chain
caggugcaccugguccagagcggcgccgaggccaagcgccccggguccagcgugcggguguccugccgcgcgagcggcggggacuucuccagcuacacccucuccuggguccggcaggcccccggccaggggaucgaguggaugggcggcguggugcccaugcuggacaccguccacuacgcccagaaguuccaggggcgccugacgcucagcguggacgagggcaccuccaccgccuacauggagcugagcucccugcggagcgaggacaccgccauguacuacugcacgcgcgggcggcagaccuuccgcgcgaucugguccggcccgcccgccguguucgacaucugggggcagggcacccucgucaucgugagcuccgccagcaccaagggc

SEQ ID NO: 12152 - RNA, 396 nt, Artificial Sequence
  derived and/or modified sequence opt1 from anti-HIV_Chain
caggugcagcugguccagagcggcgccgagcucaagaagcccggguccagcgugaagguguccugcaaggccagcggcgggaccuucaacaaccacaccuucaacuggguccgccaggcgccgggccaggggcuggaguggaugggccggacgauccccauccugggcucccgcgacuacgccaagaccuuccaggaccgggugaccaucaucgccgacaagagcaccuccacgguguaccucgagcugcgccggcucaagagcgaggacaccggggucuacuacugcgccaccuccauguacuacuucgacagcggcggguacuaccgcaacaccgaccuggacaaguggggccaggggucccuggugacggugagcuccgccagcaccaagggc

SEQ ID NO: 12153 - RNA, 396 nt, Artificial Sequence
  derived and/or modified sequence opt1 from anti-HIV_Chain
cagguguaccugguccagagcggccccgagcucaagaagccgggggccuccgugaagaucagcugcaaggccuccggcuacaacuuccccaaguacgcgauccacugggugcgccaggcccccgggcagggccugcaguggaugggguggaucaacggcgacaacggcgacgcccgguacagccagaagcugcaggggcgcgucacccccuccaccgacacgagcgccuccgugguguacauggagcucaagcggcugcgcagcgaggacaccgccgucuacuacugcgcgcgggcccuguacccgugggagaucggcggggugcccuccaccaugggcgacgacuacugggggcagggcacccucaucacggugagcuccgccagcaccaagggc

SEQ ID NO: 12154 - RNA, 396 nt, Artificial Sequence
  derived and/or modified sequence opt1 from anti-HIV_Chain
caggugcagcugguccagagcggccccgagcucaugaagccgggguccagcgugaagguguccugccgcgccagcggcgacaacuuccugaccuccaccuucaacuggcugcggcaggcccccgggcagcgccucgaguggaugggccgguucauccccagccuggggcugaucacguccgcgcccaaguucagcgaccgccucaccaucaccgccgaccaggccacccugacggccuacauggagcugaccggccucaccuccgaggacaccgcccuguacuacugcgcgcggggccugugccgcgggggcaacugccggcucgggccgagcggcuggcuggaccccugggggcgcggcacgcaggucaccguguccagcgccuccaccaagggc

SEQ ID NO: 12155 - RNA, 396 nt, Artificial Sequence
  derived and/or modified sequence opt1 from anti-HIV_Chain
ggcgugcacuuccaggggcaccugguccagagcggcgggggcgugaagaagcccggguccagcgugaccaucuccugccucgccagcgaguacaccuucacggaguucaccauccacuggauccgccaggccccgggccagggcccccuguggcuggggcucaucaagcgguccggccgccugaugaccagcuaccgguuccaggaccgccugucccuccggcgcgaccggagcaccgggacggucuucauggagcugcgcggccugcggaucgacgacaccgcgguguacuacugcgcccgcgacgggcucggcgagguggcccccgccuaccuguacggcaucgacgucugggggcagggcuccaccgugaucgugaccagcgccuccacgagc

SEQ ID NO: 12156 - RNA, 396 nt, Artificial Sequence
  derived and/or modified sequence opt1 from anti-HIV_Chain
caggugcagcugcuccagagcggcgccgaggucaagaagcccggggccuccgugaaggugagcugcaaggucuccggcuacacccugaccgagcugagcauccacugggugcgccaggcgccggggaagggccucgaguggaugggcggguucgaccccgaggacgacgaggccaucuacgagcccaaguuccagggccggcugacgaugaccgaggacaccuccaccgacacggccuacauggagcugagcucccuccgcagcgaggacaccgccguguacuacugcgccaccgcggaccccuucaaggucgcccaggacgaggggcuguacgugaucuucgacuacuggggccaggggacccuggugacggucuccagcgccuccaccaagggc

SEQ ID NO: 12157 - RNA, 396 nt, Artificial Sequence
  derived and/or modified sequence opt1 from anti-HIV_Chain
caggugcagcugguccagagcggcgccgaggugaagaagcccggggccuccgugaaggucagcugcaagguguccggcuacacccucaccgagcugagcauccacugggugcgccaggcgccggggaagggccuggaguggaugggcggguucgaccccgaggacggcgaggccuccuucgagcccaaguuccaggggcggcucacgaugaccgaggacaccagcaccgacacggccuacauggagcuguccagccugcgcuccgaggacaccgccgucuacuacugcgccaccgcggaccccuucaagguggcccaggacgagggccucuacgugaucuucgacuacugggggcagggcacccuggucacggugagcuccgccagcaccaagggg

SEQ ID NO: 12158 - RNA, 396 nt, Artificial Sequence
  derived and/or modified sequence opt1 from anti-HIV_Chain
ggcgugcacuuccaggggcaccugguccagagcggcgggggcgugaagaagcccggguccagcgugaccaucuccugccucgccagcgaguacaccuucacggaguucaccauccacuggauccgccaggccccgggccagggcccccuguggcuggggcucaucaagcgguccggccgccugaugaccagcuaccgguuccaggaccgccugucccuccggcgcgaccggagcaccgggacggucuucauggagcugcgcggccugcggaucgacgacaccgcgguguacuacugcgcccgcgacgggcucggcgagguggcccccgccuaccuguacggcaucgacgucugggggcagggcaccaccgugaucgugacguccgccagcaccucc

SEQ ID NO: 12159 - RNA, 396 nt, Artificial Sequence
  derived and/or modified sequence opt1 from anti-HIV_Chain
caggugcagcugggcgagagcgggggcgggcucgucgagcccggcgggucccugcgccugagcugcgccgccuccggcuuccucuucagcgacuaccagauguccuggauccggcuggcgccgggcaaggggcuggaguggaucagcuucaucuccggcuucgggagcguguacuacgccgacuccguggagggccgcuucaccaucagccgggacaacgcccgcaacucccucuaccugcagaugaacaaccugcgggccgaggacaccgccgucuacuacugcgcgcgcgccuacgggacgggcaacuggcggggccucuacuacuacuacuacgggauggacguguggggccacgggaccaccgugaccgucagcuccgccagcacgaagggc

SEQ ID NO: 12160 - RNA, 399 nt, Artificial Sequence
  derived and/or modified sequence opt1 from anti-HIV_Chain
caggugcagcugguccagagcggcaccgcccucaagucccccgggagcuccgccaagcugagcugcaccgugcugggcgacgaguucgggacguacuucaucuccuggauccgccaggcgccgggccaggggcucgagugggugggcggcaucgucccccacagccagcugcaguccagcgcccagaaguuccacgggcggaucaucaucuccgccggcgccggggugaccccgcccguggucagccugcagcucaccaaccugaccuucgaggacacgggcaccuacuucugcgcccgcgagcgggggcgccaccgggaccccaagaccggcgacgcgcugcgcggccgguacuucgacuucugggggcgcggcaccgggcuccggguguccacgagc

SEQ ID NO: 12161 - RNA, 399 nt, Artificial Sequence
  derived and/or modified sequence opt1 from anti-HIV_Chain
gaggugcagcugguccagagcggcgggggccucgugaagcccgggggcucccugcgccugagcugcgccgccuccggguucaccuucaagaacgcguggaugagcugggugcggcaggccccgggcaagggccucgagugggucgggcacaucaaguccaagaccgacggcgggacgaucgacuacgccgcccccgugaagggccgcuucaccaucagccgggacgacuccaagaacacccuguaccugcagaugaacagccucaagaucgaggacaccgccguguacuacugcacgaccgacaucggguccggccgcggcugggacuuccacuacuacgacagcaacgacugggggcagggcacccuggucaccguguccagcgcguccacgaagggg

SEQ ID NO: 12162 - RNA, 399 nt, Artificial Sequence
  derived and/or modified sequence opt1 from anti-HIV_Chain
caggugcagcuggucgagagcggcgggggcguggugcagcccgggcgcucccuccggcuguucugcgccgccagcggcuucgcguucaacaccuacgggaugcacuggguccgccaggccccgggcaagggccuggaguggguggccgugaccuggcacgacgggucccagaaguacuacgccgacagcgucaagggccgguucacgaucucccgcgacaacagcaagaacacccucuaccugcagaugaacucccugcgggccgaggacaccgcgaucuacuacugcgccagcgaccagggcggguucgacgacuccagcggguacuucgcccccggcggcauggacgugugggggcgcggcaccacggugaucgucuccagcgcccccaccaagggg

SEQ ID NO: 12163 - RNA, 399 nt, Artificial Sequence
  derived and/or modified sequence opt1 from anti-HIV_Chain
ggcuacagcgaggugcagcugguccaguccgggcccggccucgugaagccgagccagacccugucccugaccugcacggugagcgggggcuccaucagcaacgggggccacuacuggaacuggauccgccagcaccccggcaaggggcucgaguggaucggccacaucuacaacaucgccaccaccuacuacaaccccucccucaagagccgggucuccaucagcguggacaccuccaagaaccaguucagccugaagcuguccagcgugacggccgcggacaccgccgucuacuacugcgcccgcggguccggccgguggaccaucggggcccgcaucuacuucgacaacuggggccagggcgcccugguggcggugagcuccgccagcaccaagggg

SEQ ID NO: 12164 - RNA, 399 nt, Artificial Sequence
  derived and/or modified sequence opt1 from anti-HIV_Chain
cagcugcagcucaaggagagcggccccgggauggugaagccguccgagacccugagccugaccugcuccgucagcggcgccuccguggugagcgccaacgacuacuggggguggauccgccaggcgcccggcaaggggcucgagugcaucggcaucauccuguacacgggcuccaccuucuacaaccccagccugcagucccgggucaccaucagccgcgaccccuccaagaaccacgugagccucacccugacguccgugaccgccgccgacagcgccgucuacuacugcgcccggaucccguaccacuccgagagcuacuacaacguggugaucgggggcuucgacgucugggggcagggcacccgcgugaccguguccagcgcguccacgaagggg

SEQ ID NO: 12165 - RNA, 399 nt, Artificial Sequence
  derived and/or modified sequence opt1 from anti-HIV_Chain
ugccaggugcagcuggucgagagcggcgggggcguggugcagcccgggcgcucccuccggcugagcugcgucggcuccggguucaccuucagcuccagcggcaugcacugggugcgccaggcccccggcaaggggcuggaguggguggccgucaucuccagcgacggcuccgacgaguacuacggggacagcguggagggccgguucaccaucucccgcgacaacagcaagaacacccucuuccugcagcuggacucccucgaggcggaggacagcgccguguacuacugcgccaagacgccgccccacuacgacgcccugaccggguaccccuccagcguccuggaguucuggggccucggcacccuggugacgguguccagcgccuccaccaagggg

SEQ ID NO: 12166 - RNA, 399 nt, Artificial Sequence
  derived and/or modified sequence opt1 from anti-HIV_Chain
caggugcagcugguccagagcggcgccgacgugaagaagcccggggccuccgugaaggucagcugcaagguguccggcuacaccgugagcgagcucuccauccacuggguccgccaggcgccggggaagggccuggaguggaugggcggguucgaccccgaggacggcaagaccgugagcgcccagaacuuccaggggcgggugacgaugaccgaggacaaguccaccggcaccgccaacauggagcugcgcagccuccgguccgaggacacggccgucuacuacugcgccaccaccgugcagcugaucguggacuucugcaacgggggccccugcuacaacuucgacgacugggggcagggcacccuggucacggugagcuccgcgagcaccaagggc

SEQ ID NO: 12167 - RNA, 399 nt, Artificial Sequence
  derived and/or modified sequence opt1 from anti-HIV_Chain
ggccuggaccucgagcacgacgggcaccacaaggaggagccccgcgccagcgugaccgucuccugcgaggccagcggcuacaacuucgugaacuacaucauccacugggugcggcugaccccggggcgcggcuucgaguggauggggaugaucgacccccggcgcggccggcccugguccgcgcagaaguuccagggccgccugacgcucacccgggacaucgacagcgagcgccuguacaugcagcuguccgggcuccggggcgacgacaccgccgucuacuucugcgcccgccaggagcccgacuuccacgacgggcacggccacacccugcgggggauguucgacagcuggggccagggcuccccggugagcguguccagcgccuccacgaagggg

SEQ ID NO: 12168 - RNA, 399 nt, Artificial Sequence
  derived and/or modified sequence opt1 from anti-HIV_Chain
caggugcgccugguccagagcggcgcccagcucaagaagcccggggccuccgugaccgugagcugcgaggcguccggcuacaacuucgucaacuacaucaucaacugggugcggcagaccccggggcgcagcuucgagugggugggcaugaucgacccccggcgcgggcggcccugguccgcccagaaguuccagggccgccugacgcugacccgggacaucgacagcgagaagcucuacaugcaccuguccggccugcgcggggacgacaccgccgucuacuacugcgcccggcaggacagcgacuuccacgacggccacgggcacacccuccgcggcauguucgacuccugggggcagggcagccccgugacgguguccagcgccuccaccaagggc

SEQ ID NO: 12169 - RNA, 399 nt, Artificial Sequence
  derived and/or modified sequence opt1 from anti-HIV_Chain
caggugcgccugagccaguccggcgccgccgucgugaagaccggggcgagcgugaccaucuccugcgagacggagggcuacaccuucgucaacuacaucauccacugggugcggcagcccccggggcgcggcuucgaguggcucgggaugaucgacccccggaacggccaccccugguucggccagcgcuuccgggggcgccugagccugcggcgcgaccgguccaccgagaccguguucaugacgcucagcggccugaccuccgacgacaacgggaucuacuucugcgcccgcaacgagccccaguacuacgacggcagcgggcacucccugccgggcauguucgacuacuggggccaggggacccgggucguggugagcuccgccagcaccaagggc

SEQ ID NO: 12170 - RNA, 399 nt, Artificial Sequence
  derived and/or modified sequence opt1 from anti-HIV_Chain
caggugcgccugagccaguccggcgccgccgucaugaagaccggggcgagcgugaccaucuccugcgagacggagggcuacaacuucgugaacuacaucauccacuggguccggcggcccccggggcgcggcuucgaguggcucgggaugaucgaccccaagaacggccaccccugguucgcccaggccgugcgcggccggcugagccugcgccgggacaccuucaacgagguggucuacaugacccucuccgggcugaccagcgacgacacgggccuguacuucugcgcccgcaacgagccccaguaccacgacgggaacggccacucccucccggggauguucgacuucuggggccagggcacccuggugaccgugagcuccgccagcaccaagggg

SEQ ID NO: 12171 - RNA, 399 nt, Artificial Sequence
  derived and/or modified sequence opt1 from anti-HIV_Chain
caggugcgccugagccaguccggcgccgccgucgugaagaccggggcgagcgugaccaucuccugcgagacggagggcuacaccuucgucaacuacaucauccacugggugcggcagcccccggggcgcggcuucgaguggcucgggaugaucgacccccggaacggccaccccugguucggccagcgccugcaggggcggcugagccuccgccgggaccgcuccaccgagaccguguucaugacgcugagcggccugaccuccgacgacaccgggaucuacuucugcgcccggaacgagccccaguacuacgacggcagcgggcacucccucccgggcauguucgacuacuggggccaggggacccgcgucguggugagcuccgccagcacgaagggc

SEQ ID NO: 12172 - RNA, 399 nt, Artificial Sequence
  derived and/or modified sequence opt1 from anti-HIV_Chain
caggugcgccugagccaguccggcgccgccgucgugaagaccggggcgagcgugaccaucuccugcgagacggagggcuacaccuucgucaaccacaucauccacugggugcggcagcccccggggcgcggcuucgaguggcucgggaugaucgacccccggaacggccaccccugguucggccagcgccugcgggggcgccugagccuccggcgcgaccgguccaccgagaccguguucaugacgcugagcggccugaccuccgacgacaucgggaucuacuucugcgcccgcaacgagccccaguacuucgacggcagcgggcacucccucccgggcauguucgacuacuggggccaggggacccgggucguggugagcuccgccagcaccaagggc

SEQ ID NO: 12173 - RNA, 399 nt, Artificial Sequence
  derived and/or modified sequence opt1 from anti-HIV_Chain
caggugcaguucuuccagagcggcuccagcaugaagaaguccggggccagcgucaccaucuccugcgaggccaccggcuacaacaucaagaaccacauccugcacugggugcgccagaagcccgggcggggcuucgaguggguggggaugaucgacccgaucaacggccgccccugguucggccaggcguuccgggggcgccucacgcugacccgggaccugagcaccgagaccuucuacaugucccucagcggccugacguccgacgacaccgccaccuacuucugcgcccgccgggaggccgacuaccacgacgggaacggccacacccugcccgggauguucgacuucuggggccccggcacgcucgucaccgugagcuccgccagcaccaagggg

SEQ ID NO: 12174 - RNA, 399 nt, Artificial Sequence
  derived and/or modified sequence opt1 from anti-HIV_Chain
caggugcgccugagccaguccggcgccgccgucgugaagaccggggcgagcgugaccaucuccugcgagacggagggcuacaccuucgucaacuacaucauccacugggugcggcagagccccgggcgcggcuucgaguggcucgggaugaucgacccgcggaacggccaccccugguucggccagcgccugcgggggcgccugucccuccggcgcgaccggagcaccgagaccguguucaugacgcuguccggccugaccagcgacgacaccgccaucuacuucugcgcccgcaacgagccccaguacuacgacggguccggccacagccuccccgggauguucgacuacuggggccagggcacccgggucgugguguccagcgccuccacgaagggg

SEQ ID NO: 12175 - RNA, 399 nt, Artificial Sequence
  derived and/or modified sequence opt1 from anti-HIV_Chain
caggugcgccugagccaguccggcgccgccaugaagaagcccggggcgagcgucaccaucuccugcgagaccgagggcuacacguucaucaacuacaucauccacugggugcggcagccgcccgggcgcggcuucgaguggcucgggaugaucgacccccggaacggccgccccugguucggccagagcgugcaggggcggcugucccugcgccgggacaccuacaccgaggucguguacaugacccucagcggccugacguccgacgacgccgggcuguacuucugcgcccgcaacgagccgcaguaccacgacggcaacgggcacagccuccccggcauguucgacuacuggggccaggggacccugguggccgucuccagcgccuccaccaagggc

SEQ ID NO: 12176 - RNA, 399 nt, Artificial Sequence
  derived and/or modified sequence opt1 from anti-HIV_Chain
caggugcgccugguccagagcggcgcccagcucaagaagcccggggccuccgugaccgugagcugcgaggcguccggcuacaacuucgucaacuacaucaucaacugggugcggcagaccccggggcgcggcuucgaguggguggggaugaucgacccccggcgcggccggcccuggagcgcccagaaguuccagggccgccugacgcugacccgggacaucgacuccgagaagcucuacaugcaccugagcgggcugcgcggcgacgacaccgccgucuacuacugcgcccggcaggacuccgacuuccacgacgggcacggccacacccuccgcgggauguucgacagcuggggccagggcucccccgugacggugagcuccgccagcaccaagggg

SEQ ID NO: 12177 - RNA, 399 nt, Artificial Sequence
  derived and/or modified sequence opt1 from anti-HIV_Chain
caggugcacaccuuccagagcggcuccagcaugaagaaguccggggccagcgucaccaucuccugcgaggccacgggcuacaacaucaagaacuacauccugcacugggugcgccagaagcccgggcggggcuucgaguggguggggaugaucgacccgaucaacggccgccccugguucggccagcccuuccgggggcgccucacccugacccgggaccugagcaccgagacguucuacaugucccucagcggccugaccuccgacgacaccgcgaccuacuucugcgcccgccgggaggccgacuaccacgacgggaacggccacacgcugcccgggauguucgacuucuggggcccgggcacccucaucaccgucagcuccgccagcaccaagggg

SEQ ID NO: 12178 - RNA, 399 nt, Artificial Sequence
  derived and/or modified sequence opt1 from anti-HIV_Chain
caggugcgccuguuccagagcggcgccgccaugaagaagcccggggcguccgucaccaucagcugcgaggccuccggcuacaacuucaugaacuacuucgugcacugggugcggcagcgcccggggcggggcuucgaguggcucgggaugaucaacccccgcggcggccggcccuggagcgcccaguccguccaggggcgccugacccugacgcgggacaucagcaccgagauguucuacaugcgccucgacggccugcgguccgacgacaccgccaccuacuucugcgcccgcaacgaggcggacuaccacgacgggaacggccacagccugcgggggauguucgacuacuggggccagggcucccucaucacggugagcuccgccagcaccaagggg

SEQ ID NO: 12179 - RNA, 399 nt, Artificial Sequence
  derived and/or modified sequence opt1 from anti-HIV_Chain
caggugcagcuguuccagagcggcgccgccaugcgcaagcccggggcguccgucaccaucagcugcgaggccuccggcuacaacuucaugaacuacuucgugcacugggugcggcagcgcccggggcggggcuucgaguggcucgggaugaucaacccccgcggcggccggcccuggagcgcccaguccguccaggggcgccugacccugacgcgggacaccagcaccgagauguucuacaugcgccucgacggccugcgguccgacgacaccgccacguacuucugcgcccgcaacgaggcggacuaccacgacgggaacggccacagccugcgggggauguucgacuacuggggccagggcucccucaucaccgugagcuccgccagcaccaagggg

SEQ ID NO: 12180 - RNA, 399 nt, Artificial Sequence
  derived and/or modified sequence opt1 from anti-HIV_Chain
caggugcgccugagccaguccggcgccgccaucaagaagcccggggcgagcgucaccaucuccugcgagaccgagggcuacacguucaucaacuacaucauccacugggugcggcagccgcccgggcgcggcuucgaguggcucgggaugaucgacccccggaacggccgccccugguucggccagagcgugcaggggcggcugucccugcgccgggacaccuacaccgaggucguguacaugacccucagcggccugacguccgacgacaccgggcuguacuucugcgcccgcaacgagccgcaguaccacgacggcaacgggcacagccuccccggcauguucgacuccuggggccaggggacccugguggccgucagcuccgccagcaccaagggc

SEQ ID NO: 12181 - RNA, 399 nt, Artificial Sequence
  derived and/or modified sequence opt1 from anti-HIV_Chain
caggugcgccuguuccagagcggcgccgccaugcggaagcccggggcguccgucaccaucagcugcgaggccuccggcuacaacuuccucaacuacuucgugcacugggugcgccagcggccggggcgcggcuucgaguggcuggggaugaucaacccccggggcggccgccccuggagcgcccaguccguccaggggcggcugacccucacgcgcgacaccagcaccgagauguucuacaugcggcuggacggccugcgcuccgacgacaccgccacguacuucugcgcccggaacgaggcggacuaccacgacgggaacggccacagccuccgcgggauguucgacuacuggggccagggcucccugaucaccgugagcuccgccagcaccaagggg

SEQ ID NO: 12182 - RNA, 399 nt, Artificial Sequence
  derived and/or modified sequence opt1 from anti-HIV_Chain
caggugcgccugagccaguccggcgccgccgucaagaagcccggggcgagcgugaccaucgugugcgagaccgagggcuacaacuucaucgacuacaucauccacuggguccggcagccgcccgggcgcggcuucgaguggcucgggaugaucgacccccggaacggccgccccugguccggccagaaggugcacgggcggcugagccuguggcgcgacacguccaccgagaagguguacaugacccucaccggccugacgagcgacgacaccgggcuguacuucugcggccggaacgagccgcaguaccacgacgacaacgggcacucccuccccggcaugaucgacuacuggggccaggggaccauggucaccgugagcuccgccagcacgaagggc

SEQ ID NO: 12183 - RNA, 399 nt, Artificial Sequence
  derived and/or modified sequence opt1 from anti-HIV_Chain
caggugcgccugagccaguccggcgccgccaucaagaagcccggggcgagcgucaccaucuccugcgagaccgagggcuacacguucaucaacuacaucauccacugggugcggcagccgcccgggcgcggcuucgaguggcucgggaugaucgacccccggaacggccgccccugguucggccagagcgugcaggggcggcugucccugcgccgggacaccuacaccgaggucguguacaugacccucagcggccugacguccgacgacgccgggcacuacuucugcgcccgcaacgagccgcaguaccacgacggcaacgggcacagccugcccggcauguucgacuacuggggccaggggacccucguggccgucuccagcgccuccaccaagggc

SEQ ID NO: 12184 - RNA, 399 nt, Artificial Sequence
  derived and/or modified sequence opt1 from anti-HIV_Chain
caggugcgccuguuccagagcggcgccgccaugcggaagcccggggcguccgucaccaucagcugcgaggccuccggcuacaacuucaugaacuacuucgugcacugggugcgccagcggccggggcgcggcuucgaguggcucgggaugaucaacccccggggcggccgccccuggagcgcccaguccguccaggggcggcugacccugacgcgcgacaccagcaccgagauguucuacaugcggcucgacggccugcgcuccgacgacaccgccacguacuucugcgcccggaacgaggcggacuaccacgacgggaacggccacagccugcgcgggauguucgacuacuggggccagggcucccucaucaccgugagcuccgccagcaccaagggg

SEQ ID NO: 12185 - RNA, 399 nt, Artificial Sequence
  derived and/or modified sequence opt1 from anti-HIV_LightChain
augaagcugcccgugcgccuccugguccugauguucuggaucccggccagcuccagcgacaucgugaugacccagagcccccucucccugcccgugacccccggcgagccggccuccaucagcugccgguccagccagcgccugcucuccagcuacgggcacacguaccugcacugguaccugcagaagcccggccagagcccccagcuccugaucuacgaggucuccaaccgguucuccggggugcccgaccgcuucagcggcuccgggagcggcaccgacuucacccugaagaucucccggguggaggcggaggacgucggcguguacuacugcagccaguccacccacgugccgcucacguucgggcagggcaccaaggucgagaucaagcgcaag

SEQ ID NO: 12186 - RNA, 402 nt, Artificial Sequence
  derived and/or modified sequence opt1 from anti-HIV_Chain
cagcccuacaucgugcagagcggcccggccgucaagggggccggcuccagcgugaccgugaccugcaaggucgacggggacgacgacggcaucuucuccuucgggacguacuucauggugugggugcgccaggcgcccggccagggccugcaguacaugggcgggcucguccccagcuacgcccccaccuacgcccacaaguucgaggggcggaucaccaucuccgccgccggcaccccgcccguggugagccugacgcugcucaaccugaccaacgacgacgcggccaccuacuucugcgcccgcgagcgggggcgccacuacgacuccaagacccgggagaaccgccggggccgcuacuucgacauguggggccgggggacgcgcaucaccgucagcccc

SEQ ID NO: 12187 - RNA, 402 nt, Artificial Sequence
  derived and/or modified sequence opt1 from anti-HIV_Chain
cagcccuacaucgugcagagcggcccggccgucaagggggccggcuccagcgugaccgugaccugccgcgucgacggggacgacgacggcaucuucaacuucgggacguacuucauggugugggugcggcaggcgcccggccagggccugcaguacaugggcgggcucguccccuccuacgcccccaccuacgcccacaaguucgaggggcgcaucaccaucagcgccgccggcaccccgcccguggugucccugacgcugaucaaccucaccaacgcggacgccgccaccuacuucugcgcccgggagcgcgggcggcacuacgacagcaagacccgcgagaaccggcgcggccgguacuucgacauguggggccgcgggacgcggaucaccgucuccccc

SEQ ID NO: 12188 - RNA, 402 nt, Artificial Sequence
  derived and/or modified sequence opt1 from anti-HIV_Chain
cgcgugcacagccagguccagcugguggaguccggccccgggcucgugaagccgagccagacccugucccugaccugcacggucagcggcggguccaucagcaacggcgggcacuacuggaacuggauccggcagcaccccggcaagggccucgaguggaucgggcacaucuacaacaucgccaccaccuacuacaaccccucccucaagagccgcguguccaucagcguggacaccuccaagaaccaguucagccugaagcuguccagcgucacggccgcggacaccgccguguacuacugcgcccggggcuccgggcgcuggaccaucggcgcccggaucuacuucgacaacugggggcagggcgcccugguggcggucagcuccgccagcaccaagggc

SEQ ID NO: 12189 - RNA, 402 nt, Artificial Sequence
  derived and/or modified sequence opt1 from anti-HIV_Chain
agcguggacgagcgccugcucgaguucggcgggcggcugguccagcccggcgggucccugcgccucagcugcuccgccagcggcuucaccuucuccaacagcgccauguccugggugcggcaggcgccggggaagggccuggagugggugagcuccauccugagcuccggcgucgggaccuucuacgccgacagcgugaagggccgcuucacggugucccgggacaacagccgcaacacccucuaccugcagaugaagucccugcgggccgaggacaccgcccucuacuacugcgccaagguccagauccagcagcugaacuucggggugaucaccgacgcgggccuggacgugugggggaagggcacgacccucaucgucagcuccgccagcaccaagggc

SEQ ID NO: 12190 - RNA, 402 nt, Artificial Sequence
  derived and/or modified sequence opt1 from anti-HIV_Chain
gugcagagccaggucuaccuggugcaguccggcggggaggugaagaagcccggcagcuccgucaaggugagcugcaaggccuccggggacagcuucuccagcuccgugaucaccuggguccgccaggccccgggccaggggcccgaguggaugggccggaucauccccgugcucggcguggcggccuacgcccagaacuucuacgggcgcgucaccaucagcgccgacacguccagcaacaccgccuacauggagcuguccagccugcgguucgaggacaccgcgguguucuacugcgcccgcgagaccggccgcgggggcaaccucgcccugcggcaguacuucuucgacuccugggggcagggcacgcuggugaccgucagcucccccagcaccaagggc

SEQ ID NO: 12191 - RNA, 402 nt, Artificial Sequence
  derived and/or modified sequence opt1 from anti-HIV_Chain
cagcugcagcuccaggagagcggccccgggcuggugaagccguccgagacccugagccugaccugcuccgucagcgacggcuccaucaacagcaacuccuacuacugggccuggauccgccagagccccgggaagggccuggaguggaucggguccguguacuacuucggcggcacguacuacagccccucccucaagagccgggugaccauguccgucgaccgcagcaagaaccaguucucccucaacgugagcuccgugaccgccgcggacaccgccaucuacuacugcgcccggcacguccgccccuacgaccggagcggguacccggagcgccccaacugguucgaccccuggggccgggggacgcuggugaccguguccagcgccagcaccaagggc

SEQ ID NO: 12192 - RNA, 402 nt, Artificial Sequence
  derived and/or modified sequence opt1 from anti-HIV_Chain
caggugcagcugcaccaguggggcgccgggcuccugaagcccagcgacacccugucccugaccugcggcauccucggggucagcccgcccggcucccugacgggguacuacuggaccuggauccgccagccgcccggcaagggccucgaguggaucggggagguguaccacagcggcuccaccaacuacaaccccagccuggccucccgggugaccaucagcauggggacgaccaagacccaguucucccugcgccucaccagcgucacggcggccgacuccgccguguacuacugcgccagcggcaaggugugggggaucaccgcccggccccgcgacgcgggccuggacgucuggggccaggggaccaccgugacggugaccuccgccagcaccaagggc

SEQ ID NO: 12193 - RNA, 402 nt, Artificial Sequence
  derived and/or modified sequence opt1 from anti-HIV_Chain
caggugcagcugguccagagcggcgccgaggugaagaagcccggguccagcgugaaggucuccugccgcgccagcggcggguccuucggcaacuacgcgaucaacugggugcggcaggccccgaugcaggggcucgaguggaugggcggcaucauccccaucuucgggaccaccaacuacgcccagaacuuccgcggccgggugacgaucaacgccgacaccuucaccaacaccgucaacauggaccugagcucccugcgcagcgaggacacggccguguacuacugcgggcgguccaucaacgcggccgugcccggccucgagggggucuacuacuacuacggcauggccguguggggccaggggaccaccgugaccgucagcuccgccagcacgaagggc

SEQ ID NO: 12194 - RNA, 402 nt, Artificial Sequence
  derived and/or modified sequence opt1 from anti-HIV_Chain
uucgugcagcuggucgagagcggcgggggccucgugcagcccgggggcucccugcgccugagcugcgccgccuccggguucaacuucaacaccuacuggaugaacugggugcggcaggcgccgggcaagggccucgagugggucgccaacaugaaggaggacgggagcgagaaguacuacguggacuccgugaagggccgcuucaccaucagccgggacaacgccaagaacucccuguaccugcagaugaacagccuccgcgccgaggacacggccgucuacuacugcgcgcggaaccccgagucccgcugcaucguggggcggaaccgcggcuggugccgguacuucgaccugugggggcgcggcagccuggugaccgucucccccgccagcaccaagggc

SEQ ID NO: 12195 - RNA, 405 nt, Artificial Sequence
  derived and/or modified sequence opt1 from anti-HIV_Chain
cagcugcagcucgaccagcccggcgccgccaugaagucccuggggagcagccugaccaucacgugccgcguguccggcgacgaccucgggagcuuccacuucggcaccuacuucaugaucuggguccggcaggggccgggccagggccuggaguacaugggcgggauccugcccuccaccaagacccccaccuacgcgcacaaguuccgcgggcgggugagcaucuccgcccccggcgugccgcccguccucagccuggcccugacgaaccucaccuacgacgacaccgccaccuacuucugcgcccgcgagcgggggcgccacuucgagcccaagaaccgggaccaccuggagggcaaguuccuggaccucuggggccgcgggacguucgugcggguguccccc

SEQ ID NO: 12196 - RNA, 405 nt, Artificial Sequence
  derived and/or modified sequence opt1 from anti-HIV_Chain
caggugcagcugguccagcccggcaccgccaugaagucccucgggagcagccugaccaucacgugccgcguguccggcgacgaccuggggagcuuccacuucggcaccuacuucaugaucugggugcggcaggccccggggcagggccucgaguacaugggcgggauccugcccuccaccaagacccccacguacgcgcacaaguuccgcggccgggucagcaucuccgcccccggggugccgcccgugcugagccucgcccugaccaaccugaccuacgacgacaccgccacguacuucugcgcccgcgagcggggccgccacuucgagcccaagaaccgggacaaccucgaggggaaguucuucgaccuguggggccgcggcaccuucguccggguguccccc

SEQ ID NO: 12197 - RNA, 405 nt, Artificial Sequence
  derived and/or modified sequence opt1 from anti-HIV_Chain
caggugcagcugguccagcccggcaccgccaugaagacccucgggagcucccugacgaucagcugccgcguguccggcgacgacgggaacuuccacuucggcaccuacuucauggccugggugcggcaggucccggggcagggccuggaguacaugggcgggauccuccccagcaccaagucccccaccuacgcgcacaaguuccgcggccgggugagcaucuccacggccggggugcccccggucgugagccuggcccugaccaaccucaccuacgacgacaccgccacguacuucugcgcccgcgagcggggccgccacuacgacuccaagaagcaggagaacuaccgggggaaguucuucgaccuguggggccgcggcaccugggugcgggucagccccacc

SEQ ID NO: 12198 - RNA, 405 nt, Artificial Sequence
  derived and/or modified sequence opt1 from anti-HIV_Chain
caccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgaccagugguccgggcuccaccacgacggcgucauggccuucagcuccugggggcagggcacgcugaucagcguguccgcggccagcaccaagggg

SEQ ID NO: 12199 - RNA, 405 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggaccuucuccaccuacgcguucagcugggugcgccaggccccgaucgagggccucgaguggaugggcgggaucauccccaucuucggcacggagaacuacgcccagaaguuccaggggcgggugaccaucaccgccgacaaguccaccagcacggccuacauggagcuguccagccugcgcuccgaggacaccgcggucuacuacugcgcccgggaccgcagcuccgccaucggcuacugcagcuccaucagcugcuacaagggguccuucgacaucuggggccaggggaccauggugaccgugagcuccgccagcacgaagggc

SEQ ID NO: 12200 - RNA, 405 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggaccuucuccaccuacgcguucagcugggugcgccaggccccgggccaggggcucgaguggaugggcggcaucauccccaucuucgggacggagaacuacgcccagaaguuccagggccgggugaccaucaccgccgacaaguccaccagcacggccuacauggagcuguccagccugcgcuccgaggacaccgcggucuacuacugcgcccgggaccgcagcuccgccaucggguacugcagcuccaucagcugcuacaagggcuccuucgacaucugggggcagggcaccauggugaccgugagcuccgccagcacgaagggc

SEQ ID NO: 12201 - RNA, 405 nt, Artificial Sequence
  derived and/or modified sequence opt1 from anti-HIV_Chain
gaggugcagcuggucgagagcggcgggggccucgugcagcccgggggcucccugcgccugagcugcgccgccuccggguucaccuucagcuccuacagcaugaacugggugcggcaggcgcccggcaagggccucgagugggucuccuacaucagcggguccagcuacaccaucuacuacgccgacuccgugcgcggccgguucacgaucagccgcgacaacgccaagaacucccuguaccugcagaugaacagccuccgggacgaggacaccgccguguacuucugcgcccgcgcgaccccgcccaacccccugaaccuguacaacuacgacuccagcggguccagcuucgacuacuggggccaggggacccucgucacgguguccagcgccagcaccaagggc

SEQ ID NO: 12202 - RNA, 405 nt, Artificial Sequence
  derived and/or modified sequence opt1 from anti-HIV_Chain
gaggugcagcugguccagagcggcgccgaggugaagaagcccggguccagcgugaaggucuccugcaaggccagcggcgggaccuucuccaccuacgcguucagcugggugcgccaggccccgggccaggggcucgaguggaugggcggcaucauccccaucuucgggacggagaacuacgcccagaaguuccagggccgggugaccaucaccgccgacaaguccaccagcacggccuacauggagcuguccagccugcgcuccgaggacaccgcggucuacuacugcgcccgggaccgcagcuccgccaucggguacugcagcuccaucagcugcuacaagggcuccuucgacaucugggggcagggcaccauggugaccgugagcuccgccagcacgaagggc

SEQ ID NO: 12203 - RNA, 405 nt, Artificial Sequence
  derived and/or modified sequence opt1 from anti-HIV_Chain
gaggugcagcuggucgagagcggcgccgaggugaagaagcccggguccagcgugaaggucuccugcaaggccagcggcgggaccuucuccaccuacgcguucagcugggugcgccaggccccgggccaggggcucgaguggaugggcggcaucauccccaucuucgggacggagaacuacgcccagaaguuccagggccgggugaccaucaccgccgacaaguccaccagcacggccuacauggagcuguccagccugcgcuccgaggacaccgcggucuacuacugcgcccgggaccgcagcuccgccaucggguacugcagcuccaucagcugcuacaagggcuccuucgacaucugggggcagggcaccauggugaccgugagcuccgccagcacgaagggc

SEQ ID NO: 12204 - RNA, 405 nt, Artificial Sequence
  derived and/or modified sequence opt1 from anti-HIV_Chain
ccccuggugcagcucgagccgagcggcgucgaggugaagaagcgcggggccuccgugaaggucagcugcaagguguccggcuacagccugaccgagcuguccaugcacugggugcggcaggcccccgggaagggccucgaguggauggggagcuucgacccccuggacggcgacaccaucuacgcgcagaaguuccagggccgcgucacgaugaccguggacaccuccaccgacacggccuacauggaccugagcucccuccgguucgaggacaccgccguguacuacugcgccacccccagcaaggccuacuacuacgacuccccgaacuacgagggggacuucuacauggacgucuggggcaaggggaccacggugaucgugagcuccgcgagcaccaagggc

SEQ ID NO: 12205 - RNA, 408 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagcugaccuccgacgacaccgccguguacuucugcacgaccaccagcaccuacgacaagugguccgggcuccaccacgacggcgucauggccuucagcucccgcgggcagggcacgcugaucagcguguccgcggccagcaccaagggg

SEQ ID NO: 12206 - RNA, 408 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccaggggcuggaguacaucggccagaucuggcgguggaaguccagcgccagccaccacuuccgcggccggguccugaucuccgccguggaccucaccgggagcuccccgcccaucagcucccuggagaucaaggugaccagcgacgacaccgccgucuacuucugcacgaccaccuccaccuacgacgaguggagcgaccugcaccacgacggcgugauggccuucuccagcugggggcagggcacgcucaucuccgugagcgcggccuccaccaagggg

SEQ ID NO: 12207 - RNA, 408 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagcugaccuccgacgacaccgccguguacuucugcacgaccaccagcaccuacgaccgcugguccgggcuccaccacgacggcgucauggccuucagcuccugggggcagggcacgcugaucagcguguccgcggccagcaccaagggg

SEQ ID NO: 12208 - RNA, 408 nt, Artificial Sequence
  derived and/or modified sequence opt1 from anti-HIV_Chain
ugcaacccccgcgugcacagcgagguccagcugguggaguccggcgccgaggugaagaagccgggggccagcgucaagguggccugcaagguguccggcaagaagcucagcgaccuguccauccacuggguccggcaggcccccgggaagggccuggaguggaugggcggguucgacgaggaggacggcaagaucagcuacgagcgcaaguuccaggggcggguguccaugaccgaggacaccgcccgcgacacggccuucauggagaugagcucccuccggagcgacgacaccgccguguacuucugcgcggccgcgccccgccuggaccugggcgagcucuccagcggguuccacuucuggggccuggggacccuggucaccguguccagcgccuccacgaagggc

SEQ ID NO: 12209 - RNA, 408 nt, Artificial Sequence
  derived and/or modified sequence opt1 from anti-HIV_Chain
aucugggcgccccugaucgccgugaccuuccucguccugcacugcgagagccuggggaccugcugcugcugccaggccuccgggggcacguucaacaccuucgccaucaacugggugcgccaggccccggggcagggccucgagugggugggcggcaucauccccgucuucggcaccgccagcuacgcccagaaguuccaggggcgggugaccgugacgaccgacgagucccgcggcaccgcguacauggagcugaacagccugcgguccgaggacaccgccgucuacuacugcgcccgcgggcagacggaccucaacgacgaccuguggagcgacuacuccacccccggcuucgacuacugggggcagggcacccuggugaccgugagcuccgccagcacgaagggc

SEQ ID NO: 12210 - RNA, 408 nt, Artificial Sequence
  derived and/or modified sequence opt1 from anti-HIV_Chain
cugcagccccgcgugcacagcgagguccagcucguggaguccggcgccgaggugaagaagccgggggccagcgucaagguguccugcaaggugagcggcuacacccuguccgaccugagcaugcacuggguccggcaggcgcccgggaagggccucgaguggaugggcggguucgacgaggaggacggcgagaucaccuacgcccagaaguuccaggggcgcguguccaugacggaggacaccagccgggacaccgccuacauggagcuguccagccugcgcuccgaggacaccgccguguacuacugcgccacggcgccccggcucgagcugggcgagcugagcuccggguuccacuacuggggccucgggacccuggucaccgugagcuccgccagcaccaagggc

SEQ ID NO: 12211 - RNA, 408 nt, Artificial Sequence
  derived and/or modified sequence opt1 from anti-HIV_Chain
cagagccaggugcaccugguccaguccggcgccgaggugaagaagcccgggagcuccgugaaggucagcugccaggccuccggcgggaccuucaacaccuucgcgaucaacugggugcgccaggccccgggccaggggcucgagugggugggcggcaucauccccgucuucgggacggccagcuacgcccagaaguuccagggccgggugaccgugaccaccgacgagucccgcgggacggccuacauggagcugaacagccugcgguccgaggacaccgcggucuacuacugcgcccgcggccagaccgaccucaacgacgaccuguggagcgacuacuccacccccggguucgacuacuggggccagggcacgcuggugaccgugagcuccgccagcaccaagggg

SEQ ID NO: 12212 - RNA, 408 nt, Artificial Sequence
  derived and/or modified sequence opt1 from anti-HIV_Chain
ggcagcgaggugcagcuggucgaguccggggccgaggugaagaagcgcggcgccagcgugaaggucuccugcaaggugagcggguacucccucaccgagcugagcaugcacugggugcggcaggcgcccggcaaggggcuggaguggaugggcuccuucgacccgcucgacggcgacaccaucuacgcccagaaguuccaggggcgcgucacgaugaccguggacaccagcaccgacacggccuacauggaccuguccagccugcgguucgaggacaccgccguguacuacugcgccacccccuccaaggcguacuacuacgacagccccaacuacgagggcgacuucuacauggacgucugggggaagggcaccacggugaucguguccagcgccuccaccaagggg

SEQ ID NO: 12213 - RNA, 408 nt, Artificial Sequence
  derived and/or modified sequence opt1 from anti-HIV_Chain
caggugcagcugguccagagcggcggggaggugaagaagcccggcgccuccgugaaggucagcugcaagguguccggguacagccucaccgagcuguccaugcacugggugcgccaggccccgggcaaggggcuggaguggaugggcgucuucgacccccucgagggcgacgggguguacgugcagaaguuccggggccgcgucaucaugaccgaggacacgagcaccgacaccgcguacauggagcugaccucccugcggagcgaggacacggccaucuacuacugcgccaccaaggccaaggacuacuacuacgaguccagcgacuacucccccuacuacuacuacuacauggacgugugggggaagggcaccaccgugacggucagcuccgccagcaccaagggg

SEQ ID NO: 12214 - RNA, 408 nt, Artificial Sequence
  derived and/or modified sequence opt1 from anti-HIV_Chain
gaggugcagcugguccagagcggcgccgaggugaagaagcccggggccuccgugaaggucagcugcaagguguccggcuacacccucaccgagcugagcaugcacugggugcgccaggcgccggggaagggccuggaguggaugggggucuucgacccccucgagggcgacggcguguacgccgagaaguuccgggggcgcgugaucaugacggaggacaccuccaccgacaccggcuacauggagcugacgagccugcgguccgaggacaccgccaucuacuacugcgccaccaaggccaaggacuacuacuacgagagcuccgacuacagccccuacuacuacuacuacauggacgucugggggaagggcaccacggugaccguguccagcgcguccaccaagggg

SEQ ID NO: 12215 - RNA, 408 nt, Artificial Sequence
  derived and/or modified sequence opt1 from anti-HIV_Chain
caggugcagcugguccagagcggcgccgaggugaagaagcccggggccuccgugaaggucagcugcaaggcguccggcuacaccuucacccgcuaccacauccacugggugcggcacgccccggggcagggccucgaguggauggggaagaucaaccccagccgcgccuccacgaaguacgccaagaaguuccaggaccgggugaccaugacccgcgacaccagcacguccaccgucuacauggagcugagcucccugcggggcgacgacaccgccguguacuacugcggccgcgagauggggaccuucacgcuccugggcguggucaucgaccacuacgacuucuaccccauggacgugugggggcagggcacccccgugaccgucagcuccgcgagcaccaagggg

SEQ ID NO: 12216 - RNA, 408 nt, Artificial Sequence
  derived and/or modified sequence opt1 from anti-HIV_Chain
agccggcccccguccugccugcucggcugcuggugcugcagcggguuccugcugcccgccgugauccuccccaaccugcacucccccugccugagccuccuggagucccagccgcccagccuggccgaccucgucuccgcguucgccgugauggacauccccaucuacaucggcaccuaccgcagccaggccucccugcacagcuccagcaccaaguuccccacggacuuccuggggucccagaccggcagcguggccgucgggcagggccagaucucccaccuccgcagcguggaguggcggcugcgcaugugggaguucaucaccgcccugaaggugcacauguuccucucccggagcgaccgcggcccgcgguggaagaacgucuccagccugcugaacagccgc

SEQ ID NO: 12217 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccgggucaucaucagcgccguggaccugaccggcuccagcccgcccaucagcccccucgagaucaagaaccugaccuccgacgacaccgccguguacuucugcacgaccaccuccaccagcgaccgcugguccgggcugcaccacgacggcgucauggccuucagcuccugggggcagggcacgcucaucagcguguccgcggccagcaccaagggg

SEQ ID NO: 12218 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccgggucaucaucagcgccguggaccugaccggcuccagcccgcccaucuccagccucgagaucaagaaccugaccuccgacgacaccgccguguacuucugcacgaccgccagcaccuacgacaagugguccgggcugcaccacgacggcgucauggcguucagcuccugggggcagggcacccucaucagcguguccgccgccagcacgaagggg

SEQ ID NO: 12219 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggccccuccccgcccaucagcucccuggagaucaagaaccugaccagcgacgacaccgccguguacuucugcacgaccaccuccaccuacgacaaguggagcgggcuccaccacgacggcgucauggccuucuccagcugggggcagggcacgcugaucuccgugagcgcggccuccaccaagggg

SEQ ID NO: 12220 - RNA, 411 nt, Artificial Sequence
  derived and/or modified sequence opt1 from anti-HIV_HeavyChain
cagauccaccuggugcagagcggcaccgaggucaagaagcccggguccagcguggccguguccugcaaggccuacggcgucaacaccuucgggcucuacgcggugaacugggugcgccaggcccccggccagagccuggaguacaucgggcagaucuggcgguggaaguccagcgccucccacgacuuccgcggccgggucaucaucagcgccguggaccugacgggcuccagcccgcccaucuccagccucgagaucaagaaccugaccuccgacgacaccgccguguacuucugcaccgcgacgagcacccccgacuacugguccgggcugcaccacgacggcgucauggccuucagcuccugggggcagggcacccucaucagcguguccgccgccagcaccaagggg

SEQ ID NO: 12221 - RNA, 411 nt, Artificial Sequence
  derived and/or modified sequence opt1 from anti-HIV_HeavyChain
cagauccaccuggugcagagcggcaccggggucaagaagcccggcuccagcgugaccguguccugcaaggccuacggggucaacacguucggccucuacgccgugaacugggugcgccaggcgcccgggcagggccuggaguacaucggccagaucuggcgguggaaguccagcgccagccaccacuuccgcgggcggguccugaucuccgccguggaccucaccggcagcuccccgcccaucaccagccuggagaucaagaacgugaccuccgacgacacggccgucuacuucugcaccaccaccagcacguacgacaagugguccgggcuguaccacgacggcgugauggccuucagcuccugggggcagggcacccucaucagcguguccgcggccagcaccaagggc

SEQ ID NO: 12222 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccgggucaucaucagcgccguggaccugaccggcuccagcccgcccaucuccagccucgagaucaagaaccugaccuccgacgacaccgccguguacuucugcacgaccaccagcaccuccgacuacuggagcgggcugcaccacgacggcgucauggccuucuccagcugggggcagggcacgcucaucuccgugagcgcggccagcaccaagggg

SEQ ID NO: 12223 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgaccgcugguccgggcuccaccacgacggcgucauggccuucagcuccugggggcagggcacgcugaucagcguguccgcggccagcaccaagggg

SEQ ID NO: 12224 - RNA, 411 nt, Artificial Sequence
  derived and/or modified sequence opt1 from anti-HIV_HeavyChain
cagauccaccuggugcagagcggcaccgagguccgcaagcccggguccagcgugaccguguccugcaaggccuacggcgucaacacguucgggcucuacgccgugaacugggugcggcaggcgcccggccagagccuggaguacaucgggcagaucuggcgcuggaaguccagcgccucccaccacuuccggggccgcguccugaucagcgccguggaccucaccggcuccagcccgcccaucuccagccuggagaucaagaaccugaccuccgacgacaccgccguguacuucugcacgaccaccagcaccuacgacaagugguccgggcuccaccacgacggcgucauggccuucagcuccugggggcagggcacgcugaucagcguguccgcggccagcaccaagggg

SEQ ID NO: 12225 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgaccagugguccgggcuccaccacgacggcgucauggccuucagcuccugggggcagggcacgcugaucagcguguccgcggccagcaccaagggg

SEQ ID NO: 12226 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugagcugggugcgccaggcgcccggccagcggcuggaguacaucgggcagauccgccgguggaaguccagcgccucccaccacuuccgcggccgggucaccgugagcgccguggaccccaccggcuccagcccgcccaucuccagccuggagauccgcgaccucaccacggacgacaccgccgucuacuucugcaccaccacguccaccagcgacuacugguccgggcugcacaacgagcggggcaccgccuucagcuccugggggcagggcacccugaucagcguguccgcggccagcacgaagggg

SEQ ID NO: 12227 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccaggggcuggaguacaucggccagaucuggcgguggaaguccagcgccagccaccacuuccgcggccggguccugaucuccgccaucgaccucaccgggagcuccccgcccaucagcucccuggagaucaagaacgugaccagcgacgacaccgccguguacuucugcacgaccauguccaccuacgacaaguggagcggccugcaccacgacggggucauggccuucuccagcuggggccaggggacccucaucuccgugagcgcggccuccacgaagggc

SEQ ID NO: 12228 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacgaggucaacacguucggccucuacgccgugaacugggugcgccaggcgcccgggcagagccuggaguacaucggccagaucuggcgguggaaguccagcgccucccaccacuuccgcgggcggguccugaucagcgccguggaccucaccggcuccagcccgcccaucuccagccuggagaucaagaacgugaccuccgacgacaccgccgucuacuucugcacgaccaccagcacccacgacaagugguccggccugcaccacgacggggugauggccuucagcuccuggggccaggggacgcucaucagcguguccgcggccagcaccaagggc

SEQ ID NO: 12229 - RNA, 411 nt, Artificial Sequence
  derived and/or modified sequence opt1 from anti-HIV_HeavyChain
cagauccaccuggugcagagcggcaccgaggucaagaagcccggguccagcgugaccguguccugcaaggccuacggcgucaacacguucgggcucuacgccgugaacugggugcgccaggcgcccggccaggggcuggaguacaucggccagaucuggcgguggaaguccagcgccagccaccacuuccgcggccggguccugaucuccgccguggaccucaccgggagcuccccgcccaucagcucccuggagaucaagaacgugaccagcgacgacaccgccgucuacuucugcacgaccaccuccaccuacgacaaguggagcggccugcaccacgacggggugguggccuucuccagcuggggccaggggacgcucaucuccgucagcgcggccuccaccaagggc

SEQ ID NO: 12230 - RNA, 411 nt, Artificial Sequence
  derived and/or modified sequence opt1 from anti-HIV_Chain
caggugacccugguccagagcggcgccgaggugaagaagcccggggccuccgugcgcaucagcugccgggcguccggcuucaccuucgacgacuacagcgacuacuccuucaucccgacgaccuaccucauccacugguuccgccaggcccccgggcagggccuggaguggauggccuggaucaacagcgucaacgggggccggaacaucgcccgccaguuccagggccgggugaccguggcccgcgaccgguccaacagcaucgcguuccuggaguucuccgggcuccgccacgacgacaccgccgucuacuucugcgcccgggaccgccgggacgacgaccgcgccuggcugcuggaccccuggggccaggggacgcgggugaccgugagcuccgcgagcaccaagggc

SEQ ID NO: 12231 - RNA, 411 nt, Artificial Sequence
  derived and/or modified sequence opt1 from anti-HIV_Chain
cagauccaccuggugcagagcggcaccgaggucaagaagcccggguccagcgugaccguguccugcaaggccuacggcgucaacacguucgggcucuacgccgugaacugggugcgccaggcgcccggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgacaagugguccgggcuccaccacgacggcgucauggccuucagcuccugggggcagggcacgcugaucagcguguccgcggccagcaccaagggg

SEQ ID NO: 12232 - RNA, 414 nt, Artificial Sequence
  derived and/or modified sequence opt1 from anti-HIV_Chain
gugguccagcuggugcagagcggcgccgaggugcgcaagcccggguccagccucaaggucuccugcaagagcuccggcgggaccuucagccgguucguggugaacuggguccgccaggccccgggccaggggcuggaguggaugggcggcaugauccccaucuucgggaucgcgaaguacgcccagaaguuccaggaccgggugaccaugacggccgacgaguccaagaacaccguguaccuggacuucagcucccuccgcagcgacgacaccgccgucuacuacugcgcccgggaccgcggcgacacccggcugcuggacuacggggacuacgaggacgagcgcuacuacuacggcauggacgugugggggcagggcacgaccgugaucgucuccagcgcguccaccaagggc

SEQ ID NO: 12233 - RNA, 414 nt, Artificial Sequence
  derived and/or modified sequence opt1 from anti-HIV_Chain
caggugcagcugguccagagcggcgccgaggugcgcaagcccggguccagccucaagguguccugcaagagcuccggcgggaccuucagccgguucgucgugaacugggugcgccaggccccgggccaggggcuggaguggaugggcggcaugauccccaucuucgggaucgcgaaguacgcccagaaguuccaggaccgggucaccaugacggccgacgaguccaagaacaccguguaccuggacuucagcucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12234 - RNA, 414 nt, Artificial Sequence
  derived and/or modified sequence opt1 from anti-HIV_Chain
gaggugcagcuggucgagagcggcgccgaggugcgcaagcccggguccagccucaagguguccugcaagagcuccggcgggaccuucagccgguucgucgugaacugggugcgccaggccccgggccaggggcuggaguggaugggcggcaugauccccaucuucgggaucgcgaaguacgcccagaaguuccaggaccgggucaccaugacggccgacgaguccaagaacaccguguaccuggacuucagcucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12235 - RNA, 414 nt, Artificial Sequence
  derived and/or modified sequence opt1 from anti-HIV_Chain
caggugcagcuggucgagagcggcgccgaggugcgcaagcccggguccagccucaagguguccugcaagagcuccggcgggaccuucagccgguacgucgugaacugggugcgccaggccccgggccaggggcuggaguggaugggcggcaucauccccaucuucgggaucgcgaaguacgcccagaaguuccaggaccgggucaccaugacggccgacgagcccaagaacaccguguaccuggacuucaacucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12236 - RNA, 414 nt, Artificial Sequence
  derived and/or modified sequence opt1 from anti-HIV_Chain
caggugcagcugguccagagcggcgccgaggugcgcaagcccggguccagccucaagguguccugcaagagcuccggcgggaccuucagccgguacgucgugaacugggugcgccaggccccgggccaggggcuggaguggaugggcggcaugauccccaucuucgggaucgcgaaguacgcccagaaguuccaggaccgggucaccaugacggccgacgaguccaagaacaccguguaccuggacuucagcucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12237 - RNA, 414 nt, Artificial Sequence
  derived and/or modified sequence opt1 from anti-HIV_Chain
caggugcagcugguccagagcggcgccgaggugcgcaagcccggguccagccucaagguguccugcaagagcuccggcgggaccuucagccgguacgucgugaacugggugcgccaggccccgggccaggggcuggaguggaugggcggcaucauccccaucuucgggaucgcgaaguacgcccagaaguuccaggaccgggucaccaugacggccgacgaguccaagaacaccguguaccuggacuucagcucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12238 - RNA, 414 nt, Artificial Sequence
  derived and/or modified sequence opt1 from anti-HIV_Chain
caggugcagcuggucgagagcggcgccgaggugcgcaagcccggguccagccucaagguguccugcaagagcuccggcgggaccuucagccgguacgucgugaacugggugcgccaggccccgggccaggggcuggaguggaugggcggcaucauccccaucuucgggaucgcgaaguacgcccagaaguuccaggaccgggucaccaugacggccgacgaguccaagaacaccguguaccuggacuucagcucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12239 - RNA, 414 nt, Artificial Sequence
  derived and/or modified sequence opt1 from anti-HIV_Chain
caggugcagcugguccagagcggcgccgaggugcgcaagcccggguccagccucaagguguccugcaagagcuccggcgggaccuucagccgguacgucgugaacugggugcgccaggccccgggccaggggcuggaguggaugggcggcaucauccccaucuucgggaucgcgaaguacgcccagaaguuccaggaccgggucaccaugacggccgacgagcccaagaacaccguguaccuggacuucaacucccuccgcagcgacgacaccgccguguacuacugcgcccgggaccgcggcgacacccggcugcuggacuacggggacuacgaggacgagcgcuacuacuacggcauggacgucugggggcagggcacgaccgugaucguguccagcgcguccaccaagggc

SEQ ID NO: 12240 - RNA, 414 nt, Artificial Sequence
  derived and/or modified sequence opt1 from anti-HIV_Chain
gugguccagcuggugcagagcggcgccgaggugcgcaagcccggguccagccucaaggucuccugcaagagcuccggcgggaccuucagccgguacguggugaacuggguccgccaggccccgggccaggggcuggaguggaugggcggcaugauccccaucuucgggaucgcgaaguacgcccagaaguuccaggaccgggugaccaugacggccgacgaguccaagaacaccguguaccuggacuucagcucccuccgcagcgacgacaccgccgucuacuacugcgcccgggaccgcggcgacacccggcugcuggacuacggggacuacgaggacgagcgcuacuacuacggcauggacgugugggggcagggcacgaccgugaucgucuccagcgcguccaccaagggc

SEQ ID NO: 12241 - RNA, 414 nt, Artificial Sequence
  derived and/or modified sequence opt1 from anti-HIV_Chain
uucaucugcuucagcguggucgugcgccugcucgaguucggcgggcggcuggugcagcccggcgggucccugcgccucagcugcuccgccagcggcuucaccuucuccaacagcgccauguccuggguccggcaggcgccggggaagggccuggagugggugagcuccauccugagcuccggcguggggaccuucuacgccgacagcgucaagggccgcuucacggugucccgggacaacagccgcaacacccucuaccugcagaugaagucccugcgggccgaggacaccgcccucuacuacugcgccaaggugcagauccagcagcugaacuucggggucaucaccgacgcgggccuggacgugugggggaagggcacgacccucaucgugagcuccgccagcaccaagggc

SEQ ID NO: 12242 - RNA, 414 nt, Artificial Sequence
  derived and/or modified sequence opt1 from anti-HIV_Chain
caggugcagcugguccagagcggcgccgaggugcgcaagcccggguccagccucaagguguccugcaagagcuccggcgggaccuucagccgguacgucgugaacugggugcgccaggccccgggccaggggcuggaguggaugggcggcaucauccccaucuucgggaucgcgaaguacgcccagaaguuccaggaccgggucaccaugacggccgacgaguccaagaacaccguguaccuggacuucagcucccuccgcagcggcgacaccgccguguacuacugcgcccgggaccgcggggacacccggcugcuggacuacggcgacuacgaggacgagcgcuacuacuacgggauggacgucuggggccagggcacgaccgugaccguguccagcgcguccaccaagggg

SEQ ID NO: 12243 - RNA, 417 nt, Artificial Sequence
  derived and/or modified sequence opt1 from anti-HIV_Chain
caggugcagcuggucgagagcggcgccgaggugaagaagcccggguccagcgugaaggucuccugcaaggccagcggcgggaccuucaacaucuucgcguucuccugggugcgccaggccccgggccaggggcucgaguggaugggcggcaucauccccaucuucgccagccccaacuacgcccagcgguuccaggggcgcgugaccaucacggccgacgaguccaccagcaccguccacauggagcuguccagccugcgguccgaggacaccgcgaucuacuacugcgccaaggacgcccacaugcacaucgaggagccccgcgacuacgacuacaucuggggcacgagcccguacuacuucgacuacugggggcagggcacccucgugaccguguccagcgccuccaccaagggg

SEQ ID NO: 12244 - RNA, 417 nt, Artificial Sequence
  derived and/or modified sequence opt1 from anti-HIV_Chain
caggugcagcuggucgagagcggcgccgaggugaagaagcccggggccuccgugaaggucagcugcaaggcguccggcuacaccuucaccagccacgacaucaacugggugcgccaggccacggggcagggccucgaguggaugggguggaugaacccgaacuccggcgacaccggcuacgcccacaaguuccaggggcgggugaccaugacccgcaacacgcccaucagcaccgccuacauggagcuguccagccugcgguccgaggacaccgccgucuacuacugcgcgcgcggccgggccaccagccgcaacacgcccugggcccacuacuacgacuccagcggguacuacggcgccggggacuacuggggccagggcacccucgugaccguguccagcgcguccaccaagggg

SEQ ID NO: 12245 - RNA, 417 nt, Artificial Sequence
  derived and/or modified sequence opt1 from anti-HIV_Chain
caggugcagauccgccagagcggccccgggcuggucaagccgcucgagacccugucccugagcugcaucguguucggcggguccuucaucgccuaccacuggaccuggauccggcaggcgccccucaagggccuggaguggaucggggacaucgaccagggcggcgacaucacguacagccccucccucaagagccgcgugaccauguccgucgaccggagcaagucccaguucagccugaagcuguccagcgugaccgccgccgacgccgccguguacuacugcguccgcgggcccccgaaccgguacgccgugaccuccuucacgagcggcacccaccgcgagcgguccagcuacuacuucgacuacugggggcccggcacccuggugaccgucuccagcgcguccacgaagggg

SEQ ID NO: 12246 - RNA, 423 nt, Artificial Sequence
  derived and/or modified sequence opt1 from anti-HIV_Chain
aacggcgggagccugcgccucuccugccgggugagcggcuucggguuccaccuguacgagaugaacuggguccgccaggcccccggcaaggggcuggaguggaucuccagcaucuccggcagcggcgaguccacccacuacagcgacuccaucaccgggcgguucagcaugucccgcgacgaggccaaggacagccucuaccugcagaugaacaaccugcggguggaggacacggcgguguacuacugcacccgcggcuucuccaugggggacggcaccggguucagcuucgacaccuggggccggggcacgauggucaccguguccagcgggcucgacaccgugucccuggccagcaccaagggcccguccgucuucccccuggcccccugcagccgcagcacguccgacgcccggcucagc

SEQ ID NO: 12247 - RNA, 423 nt, Artificial Sequence
  derived and/or modified sequence opt1 from anti-HIV_Chain
caggugcagcugguccagagcggcgccgaggugaagaagcccggguccagcgugaaggucuccugcaaggccagcggcgggaccuucuccaccuacgcgaucagcugggugcgccaggccccgggccaggggcucgaguggaugggcggcaucauccccuccuucagcauguccaacuacgcccaggacuuccaggggcggcugacgaucaccgccgacgagagcaccuccagcguguacauggagcugaacucccuccgcagcgaggacaccgccgucuacuacugcgcgcgggacuucccccgcuuccaccggcuggugggcaacuacgacuucuggcgcgggacgcuggaccgguucuccuacauggaccucuggggccgcgggaccgccgugaccgucagcuccgccagcaccaagggc

SEQ ID NO: 12248 - RNA, 423 nt, Artificial Sequence
  derived and/or modified sequence opt1 from anti-HIV_Chain
cuggugcagcucgucgagagcggcgggggcguggugcagcccgggcgcucccugcggcugagcugcgccgccuccggcuucaccuucagcaccuacgcgaugcacuggguccgccaggcccccgggaagggccucgaguggguggccgugaucuccuacgacggcagcaacaaguucuacgccgacuccgucaaggggcgguucacgaucagccgcgacaacuccaagaacacccuguaccugcagaugaacagccuccgggccgaggacaccgcgguguacuacugcgcccgccccaaguuccugcccggcgccgacaucguggucgugguggccgcgacccccuucgacuacugggggcagggcaacccggggcaccggcugcucuccuuccaccagggccccaucggccugccgcccggg

SEQ ID NO: 12249 - RNA, 423 nt, Artificial Sequence
  derived and/or modified sequence opt1 from anti-HIV_HeavyChain
auggaguggagcggcguguucaucuuccugcucuccgucaccgccggggugcacagcgaggugcagcuggucgaguccggcgggggccuggugaagcccgggggcagccuccgccuguccugcgccgcgagcggcuacaccuucuccaacuacuggaucgggugggugcggcaggccccgggcaaggggcuggaguggaucggcgacaucuaccccgggggcaacuacauccgcaacaacgagaaguucaaggacaagacgacccucagcgccgacaccuccaagaacaccgccuaccugcagaugaacagccugaagacggaggacaccgccgucuacuacugcggcuccagcuucggguccaacuacguguucgcgugguucaccuacuggggccaggggacccucgugacggucagcucc

SEQ ID NO: 12250 - RNA, 423 nt, Artificial Sequence
  derived and/or modified sequence opt1 from anti-HIV_HeavyChain
auggaguggagcggcguguucaucuuccugcucuccgucaccgccggggugcacagccaggugcagcugguccaguccggccccgacgugaagaagccggggaccagcaugaagauguccugcaagacgagcggcuacaccuucuccaacuacuggaucgggugggugcgccaggcccccggccagggccuggaguggaucggggacaucuaccccggcgggaacuacauccggaacaacgagaaguucaaggacaagaccacccucacggcggacaccagcaccuccaccgccuacaugcagcugggcagccugcgcuccgaggacacggccgucuacuacugcgggagcuccuucggcagcaacuacguguucgccugguucaccuacuggggccaggggacccucgugaccgucuccagc

SEQ ID NO: 12251 - RNA, 429 nt, Artificial Sequence
  derived and/or modified sequence opt1 from anti-HIV_Chain
cagguguucguccagcuggugcagagcggcgggggccucgugcagcccgggggcuccguccgccugagcugcaccgccuccggguuccuguucagcaccuacuccaugaacugggugcggcaggccccgggcaagggccucgagugggugagcuccaucagcacgaccuccaacuacaucuacuacgcggacagcgucaaggggcgcuucaccaucucccggagcaacggccaggggucccuguaccugcagcucaacagccugcgcguggaggacaccgccguguacuacugcgcccgggacacgaaggucggcgcgccccgccaggacugcuacgccauggaccugugggggcagcgggaccacggccaccgccuccuguccuuccaccagggccccaucgggcugcccccgggcgcccuccugcag

SEQ ID NO: 12252 - RNA, 432 nt, Artificial Sequence
  derived and/or modified sequence opt1 from anti-HIV_Chain
aucauccuguuccucguggccaccgccaccggcguccacagcgacauccagaugacgcagucccccagcucccugagcgcguccgugggggaccgcgugaccaucacgugccgggccagccaguccaucgaccgcuaccugaacugguaccagcacaagcccggcaaggcccccaagcuccugaucuacgccgccagcaaccugcacaccgacguccccucccgguucagcggguccggcgcggggaccuacuucacccucaccaucaccagccugcagcccgaggacuucgccacguacuacugccagcagucccacagcccguccuucggccaggagagcuacuccaucgccuucggccaggggacccgccuggagaucaagcggaccguggccgcgcccagcguguucaucuucccgcccuccgacgag

SEQ ID NO: 12253 - RNA, 432 nt, Artificial Sequence
  derived and/or modified sequence opt1 from anti-HIV_Chain
cugcagcagcuccaggugccccgccugagcauguggcgggucuucaagguggccgccgcgaccggcgcccagacccugacgguggaggagccgggguccagcgucaagguguccugcaaggccagcggcggguccagcaccgccuacggcuacuccugggugcgccaggcccccgggcagggcuucgaguggaugggccggaucauccccuucuacgggaucaucaccuacgcgcccaaguuccagggccgcgucaccaucacggccgaccggagcaccuccaccguguacauggagcucaccagccugacguucgccgacaccgcccuguucuucugcgcgcgcgacuucggggacccgcggaacggcuacuacuucgacuccugggaccaggggcucuggcugaccgugagcuccgccagcaccaagggc

SEQ ID NO: 12254 - RNA, 432 nt, Artificial Sequence
  derived and/or modified sequence opt1 from anti-HIV_Chain
caggugcgccuggagcagagcggcgucgccaugcggaagcccggggccuccgugacccucagcugccaggcguccggcuacaacuucgugaaguacaucauccacuggguccgccagaagccggggcugggcuucgaguggguggggaugaucgaccccuaccggggccgccccuggagcgcccacaaguuccagggccggcugucccucagccgcgacaccuccauggagauccuguacaugacgcugaccagccucaaguccgacgacaccgccaccuacuucugcgcccgggccgaggcggccagcgacauccacucccgccccaucauccugacggggccgggcgaguacgggcuggaccucgagcacauggacuggaccuggcggauccugugccugcucgccguggcccccggcugccacagccag

SEQ ID NO: 12255 - RNA, 435 nt, Artificial Sequence
  derived and/or modified sequence opt1 from anti-HIV_Chain
auguuccuguuccucguggccggcgccaccgggguccagagccagguguaccuggugcccuucggcccggaggucaagaagcccggguccagcgugaagguguccugcaaggcgagcggcgacuccuucaccagcuccgucaucacgugggugcgccaggcccccgggcagggccccgaguggaugggccgggugaucccgguccuggggguggccgccuacgcccagaaguucuacggccgcgugaccaucaccgcggacaccagcuccaacacggccuacauggaggucaacagccuccgguucgaggacaccgccguguacuacugcgcccgcgagaccgggcggggcgggaaccuggcgcugcgccaguacuucuucgacuccuggggccagggcacccucgugacggucagcucccccagcaccaagggg

SEQ ID NO: 12256 - RNA, 438 nt, Artificial Sequence
  derived and/or modified sequence opt1 from anti-HIV_Chain
caggugcagcugcaggagagcggccccgggcucgucaagccguccggcacccugagccugaccugcgccguguccggggccagcaucuccagccgcaacugguggacgugggugcggcagccgcccggcaaggggcucgaguggaucggcgagaucuacgaguccggcgcgaccaacuacaaccccagccugaagucccgcgucaccaucagcguggacaaguccaagaaccaguucagccugcggcucaccuccgugacggccgccgacaccgccgucuacuucugcgcccgccugaugaccuucgggggccugaucgggacccucgacuacuggggccaggggacgcuggugaccgugcugcagcccccgccccgggcgcaccgcuaccacccccggaaccuccugcaggagcaccugugcgcccgcgucaugccc

SEQ ID NO: 12257 - RNA, 444 nt, Artificial Sequence
  derived and/or modified sequence opt1 from anti-HIV_HeavyChain
auggaguggagcggcguguucaucuuccugcucuccgucaccgccggggugcacagcgaggugcagcuggucgaguccggcgggggccuggugaagcccgggggcagccuccgccuguccugcgccgcgagcggcuacaccuucuccaacuacuggaucgggugggugcggcaggccccgggcaaggggcuggaguggaucggcgacaucuaccccgggggcaacuacauccgcaacaacgagaaguucaaggacaagacgacccucagcgccgacaccuccaagaacaccgccuaccugcagaugaacagccugaagacggaggacaccgccgucuacuacugcggcuccagcuucggguccaacuacguguucgcgugguucaccuacuggggccaggggacccucgugacggucagcuccggcgagagccugaagccccug

SEQ ID NO: 12258 - RNA, 444 nt, Artificial Sequence
  derived and/or modified sequence opt1 from anti-HIV_HeavyChain
auggaguggagcggcguguucaucuuccugcucuccgucaccgccggggugcacagccaggugcagcugguccaguccggccccgacgugaagaagccggggaccagcaugaagauguccugcaagacgagcggcuacaccuucuccaacuacuggaucgggugggugcgccaggcccccggccagggccuggaguggaucggggacaucuaccccggcgggaacuacauccggaacaacgagaaguucaaggacaagaccacccucacggcggacaccagcaccuccaccgccuacaugcagcugggcagccugcgcuccgaggacacggccgucuacuacugcgggagcuccuucggcagcaacuacguguucgccugguucaccuacuggggccaggggacccucgugaccgucuccagcggcgagucccugaagccccug

SEQ ID NO: 12259 - RNA, 447 nt, Artificial Sequence
  derived and/or modified sequence opt1 from anti-HIV_Chain
caggcccgccuggaccaguggggcaccgggcuccugaagcccagcgagacccugucccucaagugcgccguguucggcguccuguucacggacuacaacuggaccugggugcggcagagccccgggaagggccuggaguggaucgggcaccucgaccaccgcggcggcgggaacuacaaccccucccuggagagccgggugaccaucucccuggacuacagcaaggcccaguucucccuccaccugaaguccgucaccguggccgacacggcccuguacuacugcgccggcgccgugaagggguucugguucgacgaggucuacaacugguucggccccggggugcgcgagcccuggcucccgagcccccagcccccgccccgggcgcaccgcagcucccccuggcacccgccgccccgggcgccccuggugaccgccaccgucccc

SEQ ID NO: 12260 - RNA, 447 nt, Artificial Sequence
  derived and/or modified sequence opt1 from anti-HIV_Chain
caggcccgccuggaccaguggggcaccgggcuccugaagcccagcgagacccugucccucaagugcgccguguucggcguccuguucacggacuacaacuggaccugggugcggcagagcccggggaagggccuggaguggaucgggcaccucgaccaccgcggcggcgggaacuacaaccccucccuggagagccgggugaccaucucccuggacuacagcaaggcgcaguucucccuccaccucaagagcgucaccguggccgacacggcccuguacuacugcgccggcgccgugaaggggcugugguucgacgagaccuacaccugguucggccccuggucccaggggacccgcgucacgguggcgagcgccuccaccaagggccccagcguguucccgcuggcccccuccagcaaguccaccagcggcacccgggaccugucc

SEQ ID NO: 12261 - RNA, 447 nt, Artificial Sequence
  derived and/or modified sequence opt1 from anti-HIV_Chain
gccgcccgccuggaccaguggggcaccgggcucgugaagcccagcgagacccugucccugaagugcgcggucuucggcguggacuucccggacuacacguggaccugggcccggcaggcccccgggaagggccucgaguggaucgggcaccgcgaccaccggggcggcagcuccuacaaccccagccuguccgggcgcgccaccaucagccuggacaccuccaaggcccaguucagccuccacaucaaguccgugacggucgcggacaccgccaccuacuacugcgccggcgccguggcggggcugugguucgaggacgccuacaacugguucggccccuggagccaggggacccuggugacggucgccgccgccuccaccaagggcccgagcguguucccccucgcgcccuccagcaaguccaccagcggccacgccuccgugcug

SEQ ID NO: 12262 - RNA, 450 nt, Artificial Sequence
  derived and/or modified sequence opt1 from anti-HIV_Chain
cuggcccagcucgagcagagcggcgggggcguggucaagcccgggggcucccugcgccugccgugcgccgcgagcggguucaccuucaucgacuacuacauggccuggauccggcucgcccccggcaagggccuggaguggcuguccuacaucagcaagaacggggacuacaccaaguacuccgagagccucaagggccgcuucacgaucucccgggacaacgccaagaaccuggugauccugcagcucaaccgccugcgggccgacgacaccgcgaucuacuucugcgcccgcgccgacgggcugaccuacuucggcgagcuccugcaguacaucuucgaccugugggggcagggcgcccgggugaucgucagcuccgcgagcaccaagggccccuccguguucccccucgccccgagcuccaagagcacguccgggcacgccagcgug

SEQ ID NO: 12263 - RNA, 459 nt, Artificial Sequence
  derived and/or modified sequence opt1 from anti-HIV_Chain
caggugcagcugguccagagcggcgccgaggugaagaagcccggggccuccgugaaggucagcugcaagguguccggcuacacccucaccgagcugagcauccacugggugcgccaggcgcccgggaagggccuggaguggaugggcggguucgacuccgaggacggcgaggccaucuacaagcagaacuuccaggggcgggucacgaugaccgaggacaccagcaccgacacggccuacauggagcucucccgccugcggagcgaggacaccgccguguacuacugcgccaccgcggaccgcuucaagguggcccaggacgagggccuguucgucaucuucgacuacugggggcagggcaaccccgggcaccggcuccugucccugcaccagggccccaucggccugcccccggggacccucccgcccaaggccacgagcggccacgccgcgcgccgg

SEQ ID NO: 12264 - RNA, 462 nt, Artificial Sequence
  derived and/or modified sequence opt1 from anti-HIV_Chain
cuggugcagcucguccagagcggcgccgaggugaagaagcccggggccuccgugaaggucagcugcaagguguccggcuacagccugaccgagcuguccauccacugggugcgccaggcgccggggaagggccucgaguggaugggcggguucgacagcgaggacggcgaggccaucuacaagcagaacuuccaggggcgggucaccaugacggaggacaccuccaccgacaccgccuacauggagcugagccgccugcgguccgaggacacggccguguacuacugcgccaccgcggaccccuucaagguggcccaggacgagggccucuucgucaucuucgacuacugggggcagggcaccaccgggcaccgccugcugagccuccaccagggcccccaccggcuguacucccugggcacgcuccugagccgcgcccccaucgugcagacccacauggcc

SEQ ID NO: 12265 - RNA, 471 nt, Artificial Sequence
  derived and/or modified sequence opt1 from anti-HIV_Chain
cagauccaccuggugcagagcggcaccgacgucaagaagcccggguccagcgugaccguguccugcaaggccuacggcgucaacacguucgggcucuacgccgugaacugggugcgccaggcgccgggccagagccuggaguacaucgggcagaucuggcgguggaaguccagcgccucccaccacuuccgcggccggguccugaucagcgccguggaccucaccggcuccagcccgcccaucuccagccuggagaucaagaaccugaccuccgacgacaccgccguguacuucugcacgaccaccagcaccuacgaccagugguccgggcuccaccacgacggcgucauggccuucagcucccgcgggcagggcacgcugaucagcguguccgcggccagcaccaaggggcccagcguguucccccuggcccccuccagcaaguccaccuacggccucgcccacguccug

SEQ ID NO: 12266 - RNA, 477 nt, Artificial Sequence
  derived and/or modified sequence opt1 from anti-HIV_Chain
cagcaccagcuggugcccugcgucgccgaggugcgcaagccgggcgccagcgugaaggucuccugcaaggugagcggguacacccucaccgagaucuccaugcacugggugcggcaggcccccggcaaggggcuggaguggaugggcggguucgaccgcgaggacggcgagacgaucuacgcccagaaguuccagggccgggucaccaugaccgaggacaccagcacggacaccgccuacauggagcuguccagccuccgcuccgaggacaccgccguguacuacugcgccaccacguaccuggcggugguccccgacggguucgacggcuacagcuccagcugguacugguucgaccccugggggcagggcacccuggugaccguguccagcgccuccaugcaggggccgaugcuccugagccccaccggcacgcugcucccccgggcgccccugguccagacccgcccgggcccc

SEQ ID NO: 12267 - RNA, 642 nt, Artificial Sequence
  derived and/or modified sequence opt1 from anti-HIV_LightChain
gacaucgugaucacccagagcaccaaguucauguccacgagcgucggcgaccgcguguccaucacgugcaaggccagccaggacguguccaccgccgucgcgugguaccagcagaagcccgggcagagcccgaagcugcucaucuacugggccuccacccggcacaccggcgugcccgaccgcuucaccgggagcggcuccgggaccgacuacacccugacgaucagccgggugcaggccgaggaccuggcccucuacuacugccagcagcacuacaccacccccuggaccuucggcggcgggacgaagcuggagaucaagcgcaccgucgccgcgcccuccuucgugaucuucccgcccagcgacgagcagcugaaguccggcaccgccagcguggucugccuccugaacaacuucuacccccgggaggccaaggugcaguggaagguggacaacgcccugcaguccgggaacagccaggaguccgucaccgagcaggacagcaaggacuccacguacagccucagcuccacccugacccugagcaaggcggacuacgagaagcacaagguguacgccugcgaggugacccaccagggccucuccagccccgucacgaaguccuucaaccgcggggagugc

SEQ ID NO: 12268 - RNA, 651 nt, Artificial Sequence
  derived and/or modified sequence opt1 from anti-HIV_Chain
cagagcgugcugacccagcccccguccgucagcgccgcccccggccagaaggugaccaucuccugcagcggguccagcuccaacaucggcaacaacuacgugcucugguaccagcaguuccccgggacggcgcccaagcugcugaucuacggcaacaacaagcgcccgagcgggauccccgaccgguucuccggcagcaaguccggcaccagcgccacccucgggaucaccggccugcagacgggggacgaggccgacuacuucugcgccaccugggacuccggccugagcgccgacugggucuucgggggcggcaccaagcucaccgugcugucccagcccaaggcggcccccagcgugacgcuguucccgcccuccagcgaggagcuccaggccaacaaggccacccuggucugccugaucuccgacuucuaccccggggcggugaccguggccuggaaggccgacagcagccccgucaaggccggcguggagaccacgaccccguccaagcagagcaacaacaaguacgccgcguccagcuaccucucccugacccccgagcaguggaagucccaccgcagcuacagcugccaggugacccacgagggguccacggucgagaagaccguggcccccaccgagugcagc

SEQ ID NO: 12269 - RNA, 657 nt, Artificial Sequence
  derived and/or modified sequence opt1 from anti-HIV_Chain
gacaucgugaugacccagagccccgacucccuggccgucagccucggcgagcgggugaccaugaacugcaaguccagccagucccugcuguacagcacgaaccagaagaacuaccucgccugguaccagcagaagccggggcagucccccaagcugcugaucuacugggcgaacagcaccgaguccggcgugcccgaccgguucagcggguccggcagcgggaccgacuucacccucacgaucuccagcguccaggccgaggacguggccguguacuacugccagcaguacuacuccuaccgcaccuucggcggcgggaccaagcuggagaucaagcggaccgucgccgcccccagcguguucaucuucccgcccuccgacgagcagcucaagagcggcacggcguccguggucugccugcugaacaacuucuacccccgcgaggccaaggugcaguggaagguggacaacgcccugcagagcgggaacagccaggaguccgucaccgagcaggacagcaaggacuccaccuacagccucuccagcacccugacgcuguccaaggccgacuacgagaagcacaagguguacgcgugcgaggugacccaccagggccucagcucccccgucaccaagagcuucaaccgcggggagugc

SEQ ID NO: 12270 - RNA, 753 nt, Artificial Sequence
  derived and/or modified sequence opt1 from anti-HIV_SingleChain
augcagguccagcuggagcagagcggcgccgaggugaagaagcccggggccuccgugaaggugagcugccaggcguccggcuaccgcuucagcaacuucaccguccacugggugcggcaggccccggggcagcgcuucgaguggaugggcuggaucaaccccuacaacgggaacaaggaguucuccgccaaguuccaggaccgggugaccuucacggccgacaccagcgccaacaccgcguacauggagcuccgcucccugcggagcgccgacaccgccgucuacuacugcgcccgcgugggcgaguggggcugggacgacagcccccaggacaacuacuacauggacgugugggggaagggcacgaccgucaucguguccuccgggggcgggggcagcggcgggggcggguccggcggcgggggcagcgacaucgagcugacccagucccccgggacccucagccuguccccgggcgagcgggcgacguucagcugccgcuccagccacagcauccggucccgccggguggccugguaccagcacaagcccgggcaggcgccccgccuggucauccacggcgugagcaaccgggccuccggcaucagcgaccgcuucuccgggagcggcuccgggaccgacuucacccucaccaucacgcggguggagcccgaggacuucgcccuguacuacugccaggucuacggcgccagcuccuacaccuucgggcagggcaccaagcuggagcgcaag

SEQ ID NO: 12271 - RNA, 1338 nt, Artificial Sequence
  derived and/or modified sequence opt1 from anti-HIV_LightChain
gaggugaagcuggaggagagcggcgggggccucguccagcccgggggcucccgcaagcugagcugcgccgccuccggguucaccuucagcuccuucggcaugcacugggugcggcaggcgcccgagaagggccuggaguggguggccuacaucagcuccgggagcuccacccuccacuacgccgacacggucaagggccgcuucaccaucagccgggacaaccccaagaacacccuguuccugcagaugaagcuccccucccugugcuacgggcugcucggcagccgcaaccugucccaccggcugcucagccagaacgacacccccaucugccugacgguguccagcgccuccaccaaggggccgagcguguucccccuggcccccuccagcaagagcaccuccggcggcaccgcggcccucgggugccuggucaaggacuacuuccccgagccggugacggugagcuggaacuccggcgcccugaccagcgggguccacaccuuccccgccgugcuccaguccagcggccuguacucccugagcuccguggucaccgugcccagcuccagccucggcacgcagaccuacaucugcaacgugaaccacaagcccuccaacaccaaggucgacaagaagguggagcccaagagcugcgacaagacccacacgugcccgcccugccccgcgccggagcugcucgggggccccuccguguuccuguucccgcccaagcccaaggacacccugaugaucagccgcacccccgaggugaccugcgucguggucgacgugucccacgaggaccccgaggugaaguucaacugguacgucgacgggguggagguccacaacgccaagacgaagccccgggaggagcaguacaacagcaccuaccgcgugguguccguccugaccgugcuccaccaggacuggcugaacggcaaggaguacaagugcaaggugagcaacaaggcccugccggcccccaucgagaagaccaucagcaaggccaaggggcagccccgggagccccaggucuacacgcucccgcccucccgcgaggagaugaccaagaaccaggugagccugaccugccuggugaagggcuucuaccccuccgacaucgcggucgagugggagagcaacggccagccggagaacaacuacaagaccacgccgcccgugcucgacuccgacgggagcuucuuccuguacuccaagcugaccguggacaagagccgguggcagcagggcaacgucuucuccugcagcgugaugcacgaggcccuccacaaccacuacacccagaagucccugagccugucccccgggaag

SEQ ID NO: 12272 - RNA, 1380 nt, Artificial Sequence
  derived and/or modified sequence opt1 from anti-HIV_Chain
gaggugcagcuggucgagagcggcgggggccucgugaagcccgggggcucccugcgccugaccugcguggccagcggguucaccuucuccgacgucuggcucaacugggugcggcaggccccgggcaagggccuggaguggguggggcgcaucaagagccggacggacggcgggaccaccgacuacgcggccuccgucaagggccgcuucaccaucagccgggacgacuccaagaacacgcuguaccuccagaugaacagccugaagaccgaggacaccgccguguacuccugcaccacggacggguucaucaugauccgcggcgugagcgaggacuacuacuacuacuacauggacgucuggggcaaggggaccaccgugaccguguccagcgccuccacgaagggccccagcgucuucccccuggcccccuccagcaaguccaccagcgggggcaccgcggcccucggcugccuggugaaggacuacuucccggagcccgugaccgucuccuggaacagcggggcccugacgagcggcgugcacaccuuccccgccgugcuccaguccagcgggcuguacucccugagcuccgucgugaccgugcccagcuccagccucggcacccagacguacaucugcaacgucaaccacaagccguccaacaccaagguggacaagaagguggagcccaagagcugcgacaagacccacacgugcccgcccugcccggcgcccgagcugcucgggggccccuccgucuuccuguucccgcccaagcccaaggacacccugaugaucagccggacccccgaggugaccugcgucgugguggacgucucccacgaggaccccgaggugaaguucaacugguacguggacggcgucgaggugcacaacgccaagaccaagccgcgcgaggagcaguacaacagcacguaccggguggucuccgugcugaccgugcuccaccaggacuggcugaacgggaaggaguacaagugcaaggucagcaacaaggcccugcccgcccccaucgagaagaccaucuccaaggccaagggccagccccgcgagccccagguguacacccucccgcccagccgggacgagcugacgaagaaccaggugucccugaccugccucgucaagggguucuaccccagcgacaucgcgguggagugggagagcaacggccagcccgagaacaacuacaagaccaccccgcccgugcuggacuccgacgggagcuucuuccuguacuccaagcucacggucgacaagagccgcuggcagcagggcaacguguucuccugcagcgugaugcacgaggcccugcacaaccacuacacccagaagucccugagccucucccccggc

SEQ ID NO: 12273 - RNA, 1413 nt, Artificial Sequence
  derived and/or modified sequence opt1 from anti-HIV_Chain
auggaguggagcggcguguucauguuccugcucuccgucaccgccggggugcacagccaggugcagcugcagcaguccggccccgaggucgugaagccgggggccagcgugaagauguccugcaaggcgagcggcuacaccuucacguccuacgucauccacugggugcgccagaagcccgggcagggccuggacuggaucggcuacaucaaccccuacaacgacgggaccgacuacgacgagaaguucaagggcaaggccacccucaccagcgacacguccaccagcaccgccuacauggagcuguccagccugcgguccgaggacaccgccguguacuacugcgcccgcgagaaggacaacuacgcgacgggggccugguucgccuacuggggccaggggacccucgucaccgugagcuccgccagcaccaagggccccuccguguucccgcuggcgcccagcuccaagagcacgagcggcgggaccgccgcccugggcugccucgucaaggacuacuuccccgagcccgugaccguguccuggaacagcggggcccugaccuccggcguccacacguucccggccgugcugcagagcuccggccucuacagccuguccagcguggucaccgugcccuccagcucccuggggacccagaccuacaucugcaacgugaaccacaagcccagcaacacgaaggucgacaagaagguggagcccaaguccugcgacaagacccacacgugcccgcccugccccgcgcccgaguucgagggcgggccgagcguguuccucuucccgcccaagcccaaggacacccugaugaucucccggacccccgaggugaccugcgucgucguggacgugagccacgaggaccccgaggucaaguucaacugguacguggacggcguggagguccacaacgccaagaccaagccccgcgaggagcaguacaacuccaccuaccggguggugagcguccugacggugcuccaccaggacuggcugaacgggaaggaguacaagugcaagguguccaacaaggcccugcccgccagcaucgagaagaccaucagcaaggccaagggccagccgcgcgagccccaggucuacacccucccgcccucccgggacgagcugaccaagaaccaggugagccugacgugccucgugaagggcuucuaccccuccgacaucgcggucgagugggagagcaacgggcagcccgagaacaacuacaagaccacgcccccggugcuggacuccgacggcagcuucuuccuguacuccaagcucaccguggacaagagccgcuggcagcaggggaacgucuucuccugcagcgugaugcacgaggcccugcacaaccacuacacccagaagucccugagccucucccccggcaag

SEQ ID NO: 12274 - RNA, 645 nt, Artificial Sequence
  derived and/or modified sequence opt1 from anti-influenza_Fab
aucgugcugacccagagccccgccacccucuccgucagccccggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagccggaggacuucgccguguacuacugccagcacuacagcaacuggccgccccggcugaccuucggcgggggcaccaaggucgagaucaagcgcacgguggccgcccccuccguguucaucuucccgcccagcgacgagcagcugaaguccgggaccgcgagcgucgugugccuccugaacaacuucuacccccgggaggccaaggugcaguggaaggucgacaacgcccugcaguccggcaacagccaggaguccgugaccgagcaggacagcaaggacagcaccuacucccucagcuccacgcugacccugagcaaggccgacuacgagaagcacaagguguacgccugcgaggucacccaccaggggcucuccagccccgugaccaaguccuucaaccgcggcgagugc

SEQ ID NO: 12275 - RNA, 681 nt, Artificial Sequence
  derived and/or modified sequence opt1 from anti-influenza_Fab
gugcagcuggucgagagcggcgggggcguggugcagcccgggaaguccccgcgccucagcugcgccgccuccggccccaccuucagcuccuacgcgguccacugggugcggcaggcccccgggaagggccuggagugggugacccugaucagcuacgacggcgccaaccaguacuacgccgacuccgucaaggggcgcuucacgaucagccgggacaacuccaagaacaccguguaccuccagaugaacagccugcgccccgaggacaccgccguguacuacugcgcggucccgggccccguguucgggaucuucccgcccugguccuacuucgacaacuggggccaggggauccuggugaccgucagcuccgccagcacgaagggccccuccguguucccccucgcccccagcuccaagagcaccuccggcgggaccgccgcgcugggcugccuggugaaggacuacuuccccgagccggucaccgugagcuggaacagcggggcccucacguccggcgugcacaccuuccccgccguccugcagagcuccggccuguacagccucuccagcguggugaccguccccuccagcucccuggggacccagacguacaucugcaacgugaaccacaagcccagcaacaccaagguggacaagaaggucgagccgaaguccugc

SEQ ID NO: 12276 - RNA, 1515 nt, Artificial Sequence
  derived and/or modified sequence opt1 from anti-influenza_Fab
gccggcagcaccgccacccugugccucgggcaccacgcggugcccaacggcacgaucgucaagaccaucaccaacgaccagaucgaggugaccaacgccacggagcuggugcaguccagcuccaccggggagaucugcgacagcccgcaccagauccuggacggcaagaacugcacccucaucgacgcccugcugggggacccccagugcgacggcuuccagaacaagaagugggaccucuucgucgagcgcuccaaggccuacagcaacugcuaccccuacgacgugcccgacuacgccucccugcggagccugguggcguccagcggcacccucgaguucaacaacgaguccuucaacuggacgggggucacccagaacggcaccagcuccgccugcauccgccggagcaagaacuccuucuucagccgccugaacuggcugacccaccucaacuucaaguacccggcccugaacgugacgaugcccaacaacgagcaguucgacaagcuguacaucuggggcgugcaccaccccgggaccgacaaggaccagaucuuccucuacgcccaggcguccgggcggaucaccgucagcaccaagcgcucccagcagacggugagccccaacaucggcagccggccgcgcgugcggaacauccccucccgcaucagcaucuacuggaccaucgucaagcccggcgacauccugcugaucaacuccaccgggaaccucaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccucaaguccacgcaggccgcgaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaaggggagcggccggcucgucccccgc

SEQ ID NO: 12277 - RNA, 657 nt, Artificial Sequence
  derived and/or modified sequence opt1 from anti-influenza_Fab
caggugcagcugguccagagcggcgggggcguggugcagcccgggcgcucccuccggcugagcugcgccgccuccgaguucaccuuccgcauguacgcgacccacuggguccggcaggccccgggcaaggggcuggaguggguggcccucaucagcuacgacggcuccaacaaguacuacgccgacagcgugaagggccgcuucacgaucucccgggacaacagcaugaacaccgucuaccugcagaugaacacccugcgccccgaggacaccgccguguacuacugcgcgcgggaccucgggggcuacuucauccgcgggaucauggacguguggggccaggggacgcuggucaccguguccagcgccuccaccaagggccccagcguguucccccuggccccguccagcggcgggaccgccgcgcucggcugccuggucaaggacuacuuccccgagcccgugacgguguccuggaacagcggggcccugaccuccggcguccacaccuuccccgccgugcuccagagcuccggccuguacagccugagcuccguggucaccgugccgagcuccagccucgggacgcagaccuacaucugcaacgugaaccacaagcccuccaacaccaaggucgacaagcggguggagcccaag

SEQ ID NO: 12278 - RNA, 642 nt, Artificial Sequence
  derived and/or modified sequence opt1 from anti-influenza_Fab
gagcugcagaugacccagagccccuccagcguguccgccagcgucggcgaccgcgugaccaucacgugccgggccucccaggggaucagcuccuggcucgcgugguaccagcagaagccgggcaaggcccccaagcugcugaucuacgccgccagcucccuccagagcggggugcccucccgcuucagcggcuccgggagcggcaccgacuucacccugaccaucuccagccugcagcccgaggacuucgccacguacuacugccagcaggcgaacuccuucccgcucaccuucggcgggggcaccaaggucgagaucaagcggaccguggccgcccccagcguguucaucuucccgcccuccgacgagcagcucaagagcgggacggccagcgucgugugccugcugaacaacuucuacccccgcgaggcgaaggugcaguggaaggucgacaacgcccugcaguccggcaacagccaggaguccgugaccgagcaggacagcaaggacuccaccuacagccuguccagcacccucacgcuguccaaggccgacuacgagaagcacaagguguacgccugcgaggucacccaccaggggcugagcucccccgugaccaagagcuucaaccggggcgagugc

SEQ ID NO: 12279 - RNA, 993 nt, Artificial Sequence
  derived and/or modified sequence opt1 from anti-influenza_Fab
gccgaccccggcgacaccaucugcaucggguaccacgccaacaacagcaccgacacgguggacaccguccuggagaagaacgugaccgugacccacuccgucaaccuccuggaggacagccacaacggcaagcugugcaagcucaaggggaucgcgccgcugcagcugggcaagugcaacaucgccggguggcuccugggcaaccccgagugcgaccugcuccugacggccuccagcugguccuacaucguggagaccagcaacuccgagaacgggaccugcuaccccggcgacuucaucgacuacgaggagcugcgcgagcagcucagcuccgugagcuccuucgagaaguucgagaucuuccccaagaccagcuccuggccgaaccacgagacgaccaagggcgucaccgccgccugcagcuacgcgggggccuccagcuucuaccggaaccugcuguggcucaccaagaagggcuccagcuaccccaagcuguccaagagcuacgugaacaacaaggggaaggaggugcugguccucuggggcgugcaccacccgcccacgggcaccgaccagcagagccuguaccagaacgccgacgccuacguguccgucgggagcuccaaguacaaccgccgguucacccccgagaucgcggcccgccccaaggugcgggaccaggccggccgcaugaacuacuacuggacccugcucgagcccggggacacgaucaccuucgaggccaccggcaaccugaucgcccccugguacgcguucgcccugaaccggggcagcggguccggcaucaucaccagcgacgccccggugcacgacugcaacacgaagugccagacgccccacggggccaucaacuccagccuccccuuccagaacauccaccccgucaccaucggcgagugcccgaaguacgugcgcuccaccaagcugcggauggccaccgggcugcgcaacauccccagcauccagucccgg

SEQ ID NO: 12280 - RNA, 537 nt, Artificial Sequence
  derived and/or modified sequence opt1 from anti-influenza_Fab
ggccuguucggggccaucgccggcuucaucgagggcggguggaccgggaugaucgacggcugguacggcuaccaccaccagaacgagcaggggagcggcuacgcggccgaccagaaguccacccagaacgccaucgacgggaucacgaacaaggugaacagcgucaucgagaagaugaacacccaguucaccgccgugggcaaggaguucaacaaccucgagcgccggaucgagaaccugaacaagaagguggacgacggguuccuggacaucuggaccuacaacgccgagcuccugguccugcucgagaacgagcgcacgcuggacuuccacgacuccaacgugcggaaccuguacgagaaggucaagagccagcucaagaacaacgcgaaggagaucggcaacggcugcuucgaguucuaccacaagugcgacgacgccugcauggaguccgugcgcaacgggaccuacgacuaccccaaguacagcgaggaguccaagcugaaccgggaggagaucgacggcgugagcgggcgc

SEQ ID NO: 12281 - RNA, 642 nt, Artificial Sequence
  derived and/or modified sequence opt1 from anti-influenza_Apo
cagagcgugcugacccagcccccguccgucagcguggcccccggccagaccgcccgcaucacgugcgggggcaacgacaucgggcggaaguccgugcacuggaaccagcagaagcccggccaggcgcccguccucguggugugcuacgacagcgaccgcccguccgggauccccgagcgguucagcggcuccaacagcggcaacaccgccacccugaccaucucccgcgucgaggccggggacgaggccgacuacuacugccaggugugggacagcuccagcgaccacgugaucuucggcgggggcacgaagcugaccguccucgggcagcccaaggccgcgcccuccgugacccuguucccgcccagcuccgaggagcugcaggccaacaaggccacccucgugugccugaucagcgacuucuaccccggcgccgucacgguggcguggaaggccgacuccagccccgugaaggccggcgucgagaccaccaccccguccaagcagagcaacaacaaguacgccgccagcuccuaccugagccucacgcccgagcaguggaagucccaccggagcuacuccugccaggugacccacgaggggagcaccguggagaagaccgucgcgcccacggagugcucc

SEQ ID NO: 12282 - RNA, 687 nt, Artificial Sequence
  derived and/or modified sequence opt1 from anti-influenza_Apo
gaggugcagcugguccagagcggcgccgaggugaagaagcccggggccuccgugaaggucagcugcaaggcguccggcuacaccuucaccgacuaccacaucaacugggugcgccaggccccggggcagggccucgaguggaugggguggauccaccccaacagcggcgacacgaacuacgcccagaaguuccagggcugggugaccaugacccgggacaccgccaucuccacggccuacauggaggucaacgggcucaagagcgacgacaccgcgguguacuacugcgcccgcggcgggcuggagccccgguccguggacuacuacuacuacggcauggacgucugggggcagggcaccaccgugacggugagcuccgccagcaccaagggccccuccgucuucccgcuggcccccagcuccaagagcaccuccgggggcaccgcggcccuggggugccuggugaaggacuacuuccccgagcccgugacggucagcuggaacuccggcgcccucaccagcggcgugcacaccuucccggccgugcugcaguccagcgggcuguacagccucuccagcgucgugaccgugcccuccagcucccugggcacgcagaccuacaucugcaacgucaaccacaagcccagcaacaccaagguggacaagcgcguggagcccaaguccugc

SEQ ID NO: 12283 - RNA, 333 nt, Artificial Sequence
  derived and/or modified sequence opt1 from anti-influenza-A_kappa_LightChain_V-Region
gacaucgugaugacccagagccccgacucccuggccgucagccucggcgcccgcgcgaccaucaacugcaaguccagccaguccgugacguucaacuacaagaacuaccuggccugguaccagcagaagcccgggcagccgcccaaggugcugaucuacugggccagcgcccgggaguccggcguccccgaccgcuucagcggguccggcagcgggaccgacuucacccucaccaucuccagccugcaggccgaggacguggcgguguacuacugccagcagcacuaccggacgccgcccaccuucggccagggcaccaaggucgagaucaag

SEQ ID NO: 12284 - RNA, 333 nt, Artificial Sequence
  derived and/or modified sequence opt1 from anti-influenza-A_kappa_LightChain_V-Region
gacaucgugaugacccagagccccgacucccuggccgucagccucggcgagcgcgccaccaucaacugcaaguccagccaguccgugagcuccaacaacaagaacuaccuggcgugguaccagcagaagcccgggcagccgcccaaggugcugaucuacugggccagcgcccgggaguccggcguccccgaccgcuucagcggguccggcagcgggacggacuucacccucaccaucuccagccugcaggccgaggacguggccguguacuacugccagcagcacuaccggaccccgcccacguucggccagggcaccaaggucgagaucaag

SEQ ID NO: 12285 - RNA, 333 nt, Artificial Sequence
  derived and/or modified sequence opt1 from anti-influenza-A_kappa_LightChain_V-Region
gacaucgugaugacccagagccccgacucccuggccgucagccucggcgagcgcgccaccaucaacugccgguccagccaguccgugagcuccaacaacaagaacuuccuggcgugguaccaggagaagcccgggcagccgcccaaggugcugaucuacugggccagcgcccgcgaguccggcguccccgaccgguucagcggguccggcagcgggacggacuucacccucaccaucuccggccugcaggccgaggacguggccguguacuacugccagcagcacuaccgcaccccgcccacguucggccaggggaccaaggucgagaucaag

SEQ ID NO: 12286 - RNA, 333 nt, Artificial Sequence
  derived and/or modified sequence opt1 from anti-influenza-A_kappa_LightChain_V-Region
gacaucgugaugacccagagccccgacucccuggccgucagccucggcgagcgcgccaccaucaacugcaaguccagccaguccgugacguucaacuacaagaacuaccuggcgugguaccagcagaagcccgggcagccgcccaagcugcucaucuacugggccagcacccgggaguccggcgugcccgaccgcuucagcggguccggcagcgggaccgacuucacccugacgaucuccagccugcaggccgaggacgucgccguguacuacugccagcagcacuaccggaccccgcccaccuucggccagggcaccaagguggagaucaag

SEQ ID NO: 12287 - RNA, 339 nt, Artificial Sequence
  derived and/or modified sequence opt1 from anti-influenza-A_kappa_LightChain_V-Region
gacaucgugaugacccagagccccgacucccuggccgucagccucggcgagcgcgccaccaucaacugcaaguccagccaguccgugcuguacagcuccaacaacaagaacuaccuggcgugguaccagcagaagcccgggcagccgcccaagcuccugaucuacugggccagcacgcgggaguccggcgugcccgaccgcuucagcggguccggcagcgggaccgacuucacccugaccaucuccagccuccaggccgaggacgucgccguguacuacugccagcaguacuacuccacgccgcccaccuucggccagggcaccaagguggagaucaag

SEQ ID NO: 12288 - RNA, 333 nt, Artificial Sequence
  derived and/or modified sequence opt1 from anti-influenza-A_kappa_LightChain_V-Region
gacauccagaugacccagagccccgacucccuggccgugagccucggcgcccgcgcgaccaucaacugcaaguccagccaguccgucacguucaacuacaagaacuaccuggccugguaccagcagaagcccgggcagccgcccaaggugcugaucuacugggccagcgcccgggaguccggcgugcccgaccgcuucagcggguccggcagcgggaccgacuucacccucaccaucuccagccugcaggccgaggacgucgcgguguacuacugccagcagcacuaccggacgccgcccaccuucggccagggcaccaagguggagaucaag

SEQ ID NO: 12289 - RNA, 387 nt, Artificial Sequence
  derived and/or modified sequence opt1 from anti-influenza-A_HeavyChain_V-Region
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucagcuacgacggguccaacaaguacuacgccgacagcgucaagggccgguucaccaucucccgcgacaacagcaagaacacgcucuaccugcagaugaacucccugcgggccgaggacaccgccguguacuacugcgcgaaggacagccagcuccgcucccugcuguacuucgacuggcucagccagggguacuucgacuacuggggccaggggacccuggugaccgucuccagc

SEQ ID NO: 12290 - RNA, 387 nt, Artificial Sequence
  derived and/or modified sequence opt1 from anti-influenza-A_HeavyChain_V-Region
caggugcagcugguccagagcggcgggggcguggugcagcccgggcgcucccuccggcugagcugcgucgccuccggcuucaccuucagcaccuacgccaugcacugggugcgccaggcgccggggcggggccuggaguggguggccgucaucuccuacgacggcaacuacaaguacuacgccgacagcgugaaggggcgcuucuccaucagccgggacaacuccaacaacacgcuccaccuggagaugaacacccugcgcaccgaggacaccgcccucuacuacugcgccaaggacagccagcugcggucccugcucuacuucgaguggcugagccagggcuacuucgaccccugggggcagggcacgcuggugaccgucuccagc

SEQ ID NO: 12291 - RNA, 387 nt, Artificial Sequence
  derived and/or modified sequence opt1 from anti-influenza-A_HeavyChain_V-Region
caggugcagcugguccagagcggcgggggcguggugcagcccgggcgcucccuccggcugagcugcgccgccuccggcuucaccuucagcaccuacgggaugcacuggguccgccaggcgccgggcaagggccuggaguggguggccgugaucuccuacgacgggaacuacaaguacuacgccgacagcgucaagggccgguucacgaucucccgcgacaacagcaagaacacccucuaccuggagaugaacucccugcggaccgaggacaccgcccucuacuacugcgccaaggacagccagcugcgcucccugcucuacuucgacuggcugagccagggguacuucgaccacuggggccaggggacgcuggugaccguguccagc

SEQ ID NO: 12292 - RNA, 387 nt, Artificial Sequence
  derived and/or modified sequence opt1 from anti-influenza-A_HeavyChain_V-Region
caggugcagcugguccagagcggcgggggcguggugcccccggggcgcucccuccggcugagcugcgccgccuccggcuucaccuucagcaccuacgggaugcacuggguccgccaggcgcccggcaagggccuggaguggguggccgugaucuccuacgacgggaacuacaaguacuacgccgacagcguccggggccgcuucacgaucucccgggacaacagcaagaacacccucaaccuggacaugaacucccugcgcaccgaggacaccgcccucuacuacugcgccaaggacagccagcugcggucccugcucuacuucgacuggcugagccagggguacuucgaccacuggggccaggggacgcuggugaccguguccagc

SEQ ID NO: 12293 - RNA, 387 nt, Artificial Sequence
  derived and/or modified sequence opt1 from anti-influenza-A_HeavyChain_V-Region
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggccgugaucuccuacgacgccaacuacaaguacuacgccgacagcgucaagggccgguucacgaucucccgcgacaacagcaagaacacccucuaccugcagaugaacucccugcgggcggaggacaccgccguguacuacugcgccaaggacagccagcuccgcucccugcuguacuucgaguggcucagccagggguacuucgacuacuggggccaggggacccuggugacggucuccagc

SEQ ID NO: 12294 - RNA, 387 nt, Artificial Sequence
  derived and/or modified sequence opt1 from anti-influenza-A_HeavyChain_V-Region
caggugcagcuggucgagagcggcgggggcguggugcagcccgggcgcucccuccggcugagcugcgccgccuccggcuucaccuucagcaccuacgcgaugcacuggguccgccaggccccggggaagggccuggaguggguggccgugaucuccuacgacggcaacuacaaguacuacgccgacagcgucaaggggcgguucacgaucucccgcgacaacagcaagaacacccucuaccugcagaugaacucccugcgggccgaggacaccgcgguguacuacugcgccaaggacagccagcuccgcucccugcuguacuucgaguggcucagccagggcuacuucgaccccugggggcagggcacccuggugacggucuccagc

SEQ ID NO: 12295 - RNA, 387 nt, Artificial Sequence
  derived and/or modified sequence opt1 from anti-influenza-A_HeavyChain_V-Region
caggugcagcugguccagagcggcgggggcguggugcagcccgggcgcucccuccggcugagcugcgucgccuccggcuucaccuucagcaccuacgccaugcacugggugcgccaggcgccggggcggggccuggaguggguggccgucaucuccuacgacggcaacuacaaguacuacgccgacagcgugaaggggcgcuucuccaucagccgggacaacuccaacaacacgcuccaccuggagaugaacacccugcgcaccgaggacaccgcccucuacuacugcgccaaggacagccagcugcggucccugcucuacuucgaguggcugagccagggcuacuucgaccccugggggcagggcacgcuggugaccgucaccucc

SEQ ID NO: 12296 - RNA, 330 nt, Artificial Sequence
  derived and/or modified sequence opt1 from anti-influenza-A_LightChain_V-Region
aacuucaugcugacccagcccccgagcgccuccggcacccccgggcagcgcgugacgaucagcugcuccggcagcuccagcaacaucgggggcaacaccguccacugguuccagcagcuccccgggaccgcccccaagcugcugaucuacaccaacucccuccggccgagcggcgugcccgaccgcuucuccggcagcaaguccgggacgagcgcgucccuggccaucagcggccugcaguccgaggacgaggccgacuacuacugcgccgccugggacgacagccucaacgggcaggucuucggcgggggcaccaagcugaccgugcug

SEQ ID NO: 12297 - RNA, 390 nt, Artificial Sequence
  derived and/or modified sequence opt1 from anti-influenza-A_HeavyChain_V-Region
caggugcagcugcucgagagcggcgggggcgucgugcagcccgggcgcucccugcggcugagcugcgccgccuccggcuucaccuucagcaacuacgggaugcacugggugcgccaggcgccgggcaagggccucgagugggucgccaucaucuccuucgacgggagcaagaaguacuacgccaacuccgugaagggccggagcaccaucucccgcgacaacagcaagaacacgcugucccugcagaugaacagccucgggcccgaggacaccgcccuguacuacugcgccaagcugcccucccccuacuacuucgacagccgguucgugugggucgcggccuccgccuuccacuucuggggccaggggauccucgugaccgugagcucc

SEQ ID NO: 12298 - RNA, 132 nt, Artificial Sequence
  derived and/or modified sequence opt1 from anti-influenza_Chain
aacgugcccgaguggagcuacaucgucgagaaggccaacccggccaacgaccugugcuaccccggcaacuucaacgacuacgaggagcugaagcaccuccugucccgcaucaaccacuucgagaagauccag

SEQ ID NO: 12299 - RNA, 162 nt, Artificial Sequence
  derived and/or modified sequence opt1 from anti-influenza_Chain
agcggccgccuggugccccggggguccccgggcagcggguacauccccgaggccccgcgcgacggccaggccuacguccggaaggacggggagugggugcuccuguccaccuuccugggcaagcccauccccaacccccuccugggccuggacagcaccggg

SEQ ID NO: 12300 - RNA, 291 nt, Artificial Sequence
  derived and/or modified sequence opt1 from anti-influenza_Chain
augagccugcucaccgagguggagacccccauccgcaacgaguggggcugccggugcaacggguccagcgacccgcuggccaucgccgcgaacaucaucggcauccugcaccucauccuguggauccuggaccgccucuucuucaagugcaucuaccggcgcuucaaguacgggcugaagggcgggcccuccacggagggcguccccaagagcaugcgggaggaguaccgcaaggagcagcaguccgccguggacgccgacgacggccacuucgugagcaucgagcuggag

SEQ ID NO: 12301 - RNA, 300 nt, Artificial Sequence
  derived and/or modified sequence opt1 from anti-influenza_Chain
augaacaacgccaccuucaacugcaccaacaucaaccccaucacgcacauccgcggcagcaucaucaucaccaucugcgugucccugaucgucauccucaucguguucgggugcaucgccaagaucuucaucaacaagaacaacugcaccaacaacgugauccggguccacaagcgcaucaagugcccggacugcgagcccuucugcaacaagcgggacgacaucagcacgccccgcgcgggcguggacauccccuccuucauccugccggggcugaaccucagcgagggcacccccaac

SEQ ID NO: 12302 - RNA, 300 nt, Artificial Sequence
  derived and/or modified sequence opt1 from anti-influenza_Chain
gagcugacccagagccccuccagccucuccgccagcgugggcgacuccgucaccaucacgugccgcaccagcgagcggaucuccaccuaccugaacugguaccagcagaagccggggaaggcgccccgccugcucgugagcggcgccuccacccugcagggcggggugcccagccgguucuccgggagcggcuccggcacggccuucacccugaccaucaacagccuccagcccgaggacuucgccaccuacuacugccagcaguccuacagcacgccgcugaccuucgggggcgggacc

SEQ ID NO: 12303 - RNA, 300 nt, Artificial Sequence
  derived and/or modified sequence opt1 from anti-influenza_Chain
augacccagagccccuccagcauguccgugagccugggcgacaccgucuccaucacgugccacgccagccaggacaucuccgggcacaucggcuggcuccagcagaagccgggcaagagcuucaaggggcugaucuaccacgggaccaaccuggaggacggcgugcccucccgcuucagcggcuccgggagcggcgccgacuucucccucaccaucagcucccuggagagcgaggacuucgcggacuacuacugcgugcaguacguccaguuccccuggaccuucgggggcgggacgaag

SEQ ID NO: 12304 - RNA, 306 nt, Artificial Sequence
  derived and/or modified sequence opt1 from anti-influenza_Chain
gacauccaggugacccagagccccuccagccuguccgccagcgucggcgaccgcgugaccaucuccugccgggcccagagccucuccagcuaccugcacugguaccagcagaagcccgggcagccgcccaagcugcucaucuacgcggccacgacccugcaguccggcgugcccagccgcuucuccgggagcggcuccgggaccgacuucacccugacgaucagcaccuuccaggccgaggacgucgccaccuacuacugccagcagucccggaccuucggccagggcacgaagguggagaucaag

SEQ ID NO: 12305 - RNA, 306 nt, Artificial Sequence
  derived and/or modified sequence opt1 from anti-influenza_Chain
gacauccagaugacccagagccccuccagccuguccgccagcgugggcgaccgcgucaccaucuccugccgggcccagagccucuccagcuaccugcacugguaccagcagaagcccgggcagccgcccaagcugcucaucuacgcggccacgacccugcaguccggcgugcccagccgcuucuccgggagcggcuccgggaccgacuucacccugacgaucagcaccuuccaggccgaggacguggccaccuacuacugccagcagucccggaccuucggccagggcacgaaggucgagaucaag

SEQ ID NO: 12306 - RNA, 309 nt, Artificial Sequence
  derived and/or modified sequence opt1 from anti-influenza_Chain
gacauccagaucacccagagccccuccagccuguccgccagcgugggcgaccgcgucaccaucacgugccggaccucccagagccucuccagcuaccugcacugguaccagcagaagccggggaaggcccccaagcugcucaucuacgcggccuccagccugcaguccggcgugcccagccgcuucuccgggagcggcuccgggaccgacuucacccugacgaucagcucccuccagcccgaggacuucgccaccuacuacugccagcagagccggaccuucggccagggcaccaagguggagaucaag

SEQ ID NO: 12307 - RNA, 309 nt, Artificial Sequence
  derived and/or modified sequence opt1 from anti-influenza_Chain
gacauccagaugacccagagccccuccagccuguccgccagcgugggcgaccgcgucaccaucacgugccggaccucccagagccucuccagcuaccugcacugguaccagcagaagccggggaaggcccccaagcugcucaucuacgcggccuccagccugcaguccggcgugcccagccgcuucuccgggagcggcuccgggaccgacuucacccugacgaucagcucccuccagcccgaggacuucgccaccuacuacugccagcagagccggaccuucggccagggcaccaagguggagaucaag

SEQ ID NO: 12308 - RNA, 309 nt, Artificial Sequence
  derived and/or modified sequence opt1 from anti-influenza_Chain
gacauccaggugacccagagccccuccagccuguccgccagcgucggcgaccgcgugaccaucuccugccgggccagccagcgccucaacuccuaccugcacugguaccagcagacgccggggcaggcgcccaagcugcucaucuacgccaccagcacccugcaguccggcgugagcccccgguucuccgggagcggcuccgggaccgacuucacgcugaccaucagcucccuccagcccgaggacgucgccaccuacuacugccagcugagccgcaccuucggccacggcacgaagguggagaucaag

SEQ ID NO: 12309 - RNA, 309 nt, Artificial Sequence
  derived and/or modified sequence opt1 from anti-influenza_Chain
gacauccagaugacccagagccccuccagccuguccgccagcgugggcgaccgcgucaccaucuccugccgggccagccagcgccucaacuccuaccugcacugguaccagcagacgccggggcaggcgcccaagcugcucaucuacgccaccagcacccugcaguccggcgugagcccccgguucuccgggagcggcuccgggaccgacuucacgcugaccaucagcucccuccagcccgaggacguggccaccuacuacugccagcugagccgcaccuucggccacggcacgaaggucgagaucaag

SEQ ID NO: 12310 - RNA, 309 nt, Artificial Sequence
  derived and/or modified sequence opt1 from anti-influenza_Chain
gacauccaggugacccagagccccuccagccuguccgccagcgucggcgaccgcaucaccaucuccugccggacgagccagucccuccgcagcuaccugcacugguaccagcagaagccggggaaggcccccaagcugcucaucuacgcguccagcacccugcaguccggcgugcccagccgguucuccgggagcggcuccgggaccgacuucacccugacgaucagcaaccuccagcccgaggacuucgccaccuacuacugccagcugucccgcaccuucggccagggcaccaagguggagaucaag

SEQ ID NO: 12311 - RNA, 309 nt, Artificial Sequence
  derived and/or modified sequence opt1 from anti-influenza_Chain
gacauccagaugacccagagccccuccagccuguccgccagcgugggcgaccgcaucaccaucuccugccggacgagccagucccuccgcagcuaccugcacugguaccagcagaagccggggaaggcccccaagcugcucaucuacgcguccagcacccugcaguccggcguccccagccgguucuccgggagcggcuccgggaccgacuucacccugacgaucagcaaccuccagcccgaggacuucgccaccuacuacugccagcugucccgcaccuucggccagggcaccaagguggagaucaag

SEQ ID NO: 12312 - RNA, 309 nt, Artificial Sequence
  derived and/or modified sequence opt1 from anti-influenza_Chain
gacauccagaugacccagagccccuccagccuguccgccagcgugggcgaccgcgucaccaucacgugccggaccucccagagccucuccagcuacacccacugguaccagcagaagccggggaaggcccccaagcugcugaucuacgcggccuccagccgccucuccggcgugcccagccgguucuccgggagcggcuccgggaccgacuucacgcugaccaucagcucccugcagcccgaggacuucgccaccuacuacugccagcagagccgcaccuucggccagggcacgaagguggagaucaag

SEQ ID NO: 12313 - RNA, 309 nt, Artificial Sequence
  derived and/or modified sequence opt1 from anti-influenza_Chain
gacauccagaugacccagagccccuccagccuguccgccagcgugggcgaccgcgucaccaucacgugccggaccucccagagccucuccagcuacacccacugguaccagcagaagccggggaaggcccccaagcugcugaucuacgcggccuccagccgcggcuccggggugcccagccgguucuccggcagcggguccggcaccgacuucacgcucaccaucagcucccugcagcccgaggacuucgccaccuacuacugccagcagagccgcaccuucggccaggggacgaagguggagaucaag

SEQ ID NO: 12314 - RNA, 309 nt, Artificial Sequence
  derived and/or modified sequence opt1 from anti-influenza_Chain
gacauccagaugacccagagccccuccagccuguccgccagcgugggcgaccgcgucaccaucacgugccggaccucccagagccucuccagcuacgaccacugguaccagcagaagccggggaaggcccccaagcugcugaucuacgcggccuccagccgccucuccggcgugcccagccgguucuccgggagcggcuccgggaccgacuucacccugacgaucagcucccugcagcccgaggacuucgccaccuacuacugccagcagagccgcaccuucggccagggcaccaagguggagaucaag

SEQ ID NO: 12315 - RNA, 318 nt, Artificial Sequence
  derived and/or modified sequence opt1 from anti-influenza_Chain
gagaucgugaugacccagagccccgacacccuguccgucagcccgggcgagcgcgccacgcucuccugccgggccagccaguccgugaaccgccggcuggcgugguaccagcagaagcccgggcaggcgccccgccugcucauccacgacgccagcacccgggccaccggcauccccgcccgcuucuccgggagcggcuccgggaccgaguucacgcugaccaucagcucccugcagagcgaggacuucgccguguacuacugccagcaguacgacaacuggcucuccuucggccagggcacccggcuggagaucaag

SEQ ID NO: 12316 - RNA, 318 nt, Artificial Sequence
  derived and/or modified sequence opt1 from anti-influenza_Chain
gacauccagcugacccagagccccuccagccucuccgccagcgugggcgaccgcgucaccaucacgugccgggccucccaggggauccugaacugccuggcgugguaccagcagaagccgggcaaggugcccaaccuccugauguacgccgccagcacccugcaguccggggugcccagccgcuucuccggcagcggguucggcaccgacuucacccucacgaucuccagccugcagcccgaggacgucgccaccuacuacugccagaccuacggcgggguguccaccuucggcgggggcacgaagguggagauccgg

SEQ ID NO: 12317 - RNA, 318 nt, Artificial Sequence
  derived and/or modified sequence opt1 from anti-influenza_Chain
agcuacgugcugacccagcccccguccgucagcguggcccccggccagaccgcccgcaucuccugcgggggcagcaacaucgggggcaaguccgugcacugguaccagcagaagcccgggcaggcgcccguccucgugguguacgacgacagcggccggccguccggcauccccgagcgcuucagcggguccaacagcggcgacacggccacccugaccaucucccgggucgaggccggggacgaggccgacuacuucugccaggugugggacaacuucggcgggguguucggcaccggcacgaaggucaccgugcug

SEQ ID NO: 12318 - RNA, 318 nt, Artificial Sequence
  derived and/or modified sequence opt1 from anti-influenza_Chain
gacauccagaugacccagagccccuccagccuguccgccagcgugggcgaccgcgucaccaucacgugccggaccucccagagcaucuccagcuaccucaacugguaccagcagaagccggggaaggcccccaagcugcugaucuacgcggccuccagccuccaguccggcgugcccagccgcuucuccgggagcggcuccgggaccgacuucacccugacgaucagcggccugcagcccgaggacuucgccaccuacuacugccagcaguccuacagcaugccggccuucggccaggggaccaagcucgagaucaag

SEQ ID NO: 12319 - RNA, 318 nt, Artificial Sequence
  derived and/or modified sequence opt1 from anti-influenza_Chain
gacauccagaugacccagagcccccuguccgugagcgucuccgugggcgaccgcgugaccaucgccugccgggccagccaguccaucgacaaguuccucaacugguaccagcagaagccggggaaggcgcccaagcugcugaucuacggcgccagcaaccuccacuccggggcccccagccgcuucuccgccagcggcuccgggacggacuucacccugaccaucaccaacauccagacggaggacuucgccaccuaccugugccagcagagcuucuccguccccgcguucggcggcgggaccaagguggagaucaag

SEQ ID NO: 12320 - RNA, 318 nt, Artificial Sequence
  derived and/or modified sequence opt1 from anti-influenza_Chain
gacauccagaugacccagagcccguccagccuguccgccagcgugggcgaccgcgucaccaucacgugccgggccucccagagcaucuccaccuaccucaacugguaccagaagcgcccggggaaggcgcccaagcugcugguguacggcgccagcacccuccaguccggggugcccagccgguucuccggcagcggguccggcaccgacuucacgcugaccaucgccagccugcagcccgaggacuccgccaccuacuacugccagcagaccuacagcaucccccucuucggccaggggacgcgccuggagaucaag

SEQ ID NO: 12321 - RNA, 318 nt, Artificial Sequence
  derived and/or modified sequence opt1 from anti-influenza_Chain
gacauccagaugacccagagcccguccagccuguccgccagcgugggcgaccgcgucaccaucacgugccgggccucccagagcaucuccaccuaccucaacugguaccagaagcgcccggggaaggcgcccaagcugcugguguacggcgccagcucccuccagagcggggugcccucccgguucagcggcuccgggagcggcaccgacuucacccugacgaucgccucccugcagcccgaggacagcgccgucuacuacugccagcagaccuacuccaucccccucuucggccaggggacccgccuggagaucaag

SEQ ID NO: 12322 - RNA, 318 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucucccgcuaccucaacugguaccagcagaagccggggaaggcgcccaagcugcugaucuacggcgccagcacccuccagaacggggcccccucccgguucagcggcuccgggagcggcaccgacuucacccugacgaucuccagccugcagcccgaggacuccgccaccuaccucugccagcagagcuacuccgugccggccuucggcgggggcaccaagguggaggucaag

SEQ ID NO: 12323 - RNA, 318 nt, Artificial Sequence
  derived and/or modified sequence opt1 from anti-influenza_Chain
ggcauccagaugacccagagccccuccagccuguccgccagcgugggggaccgcgucaccaucacgugccgggccucccagagcaucucccgcuaccucaacugguaccugcagaagccgggcaaggcgcccaagcugcucaucagcggggccuccagccugcaguccggcgugcccagccgguucuccgggaccggcagcggcaccgaguucacccugacgaucuccagccuccagcccgaggacuucgccaccuacuacugccagcagaccuucuccaucccgcuguucgggcagggcaccaagguggagaucaag

SEQ ID NO: 12324 - RNA, 321 nt, Artificial Sequence
  derived and/or modified sequence opt1 from anti-influenza_Chain
gacauccagaugacccagagccccuccagccuguccgccagcgugggcgaccgcgucuccaucacgugccaggccagccaggacaucucccgguaccucaacugguaccagcagaagccgggggaggcgcccaagcugcugaucuacgacgccagcaaccucgagaccggcgugcccucccgcuucagcggguccggcagcgggaccgacuucaccuucaccaucuccagccugcagcccgaggacaucgccacguacuucugccagcaguacggcuaccugccgcucaccuucggccccgggaccaagguggacuccaag

SEQ ID NO: 12325 - RNA, 321 nt, Artificial Sequence
  derived and/or modified sequence opt1 from anti-influenza_Chain
gacauccagaugacccagagccccuccagcuucuccgugagccugggcgaccgcgucaccaucacgugcaaggccuccgaggacaucuacaaccggcucgccugguaccagcagaagccggggaacgcgccccgccugcugaucagcgacaccaccaaccucuggaucggcgugcccucccgguucagcggguccggcagcgggaaggacuacacccuguccaucacgagccugcaguccgaggacguggccaccuacuacugccagcaguacuggagcucccgcaccuucggcggcgggaccaagcucgagaucaagcgg

SEQ ID NO: 12326 - RNA, 321 nt, Artificial Sequence
  derived and/or modified sequence opt1 from anti-influenza_Chain
gacauccagaugacccagagccccuccagcuucuccgugagccugggcgaccgcgucaccaucacgugcaaggccuccgaggacaucuacaaccggguggccugguaccagcagaagccggggaacgcgccccgccuccugaugagcgacgccaccucccugggcgccggggugcccagccgguucuccggcagcggguccggcaaggaccacacccucagcaucaccucccugcagacggaggacgucgccaccuacuacugccagcaguacuggaacacccgcaccuucggcgggggcacgaagcuggagaucaagcgg

SEQ ID NO: 12327 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucuccaccuaccucaacugguaccagcagaagcccgggaucccgcccaagcugcugaucaacguggcgagcucccuccagagcggcgugcccucccgcuucagcggguccggcagcgggaccgacuucacccugacgaucuccagccugcagcccgaggacuucgccuccuacuacugccagcagaccuacagcuccccgcccaccuucggccagggcaccaaggucgagaucaag

SEQ ID NO: 12328 - RNA, 321 nt, Artificial Sequence
  derived and/or modified sequence opt1 from anti-influenza_Chain
gacauccagaugacccagagccccuccacccugagcggcuccgugggggaccgcgucacgaucacgugccgggccagccagaacaucggcccguggcucgccugguaccagcaggaguccgggaaggcgcccaagcugcugaucagccgcgccuccauccucgagagcggcgugcccucccgguucagcgggaccggcaccggcaccgaguucacccugaccaucuccagccugcagcccgacgacuucgccaccuacuacugccagcacuacaacgccuacugggggacguucggccaggggaccaagguggagaucaac

SEQ ID NO: 12329 - RNA, 321 nt, Artificial Sequence
  derived and/or modified sequence opt1 from anti-influenza_Chain
gugaucuggaugacccagagccccucccugcucagcgccuccaccggcgaccgcgucacgaucagcugccggaugucccaggggaucagcuccuaccuggccugguaccagcagaagccgggcaaggcgcccgagcugcucauccacaccgccuacacccucaagagcggggugcccucccgcuucagcggcuccgggagcggcaaggacuucacccugacgaucuccggccugcagagcgaggacuucgccaccuacuacugccagcaguacuacuccuuccccuacaccuucgggcagggcaccaagguggagaucaag

SEQ ID NO: 12330 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacgugagcaccuggcuggcgugguaccagcucaagccggggaaggcccccaagcugcugaucuacgccgccuccagccuccaguccggcguccccagccgcuucuccgggagcggcuccgggaccgacuucacccugacggugagcucccugcagcccgaggacuucgccaccuacuacugccagcaggcgaacagcuucccguucaccuucggccccggcaccaagguggacaucaag

SEQ ID NO: 12331 - RNA, 321 nt, Artificial Sequence
  derived and/or modified sequence opt1 from anti-influenza_Chain
gacauccagcugacccagagccccuccuuccucagcgccuccgugggcgacggggucaccaucacgugccgcgccagccaggacaucuacaucuaccuggcgugguaccagcagaagccgggcaaggcccccaagcugcucaucuacgccgccuccacccugcagggcggggugcccagccgguucuccgggagcggcuccggcaccgaguucacccugacgaucaacaaccuccagcccgaggacuucgccaccuacuucugccagcagcugaacggguacccgcugaccuucggcgggggcaccaagguggagaucaag

SEQ ID NO: 12332 - RNA, 321 nt, Artificial Sequence
  derived and/or modified sequence opt1 from anti-influenza_Chain
gacauccagcugacccagagccccuccagccucuccgccagcgugggcgaccgcgucacccugacgugccaggccucccaggacauccggaaguuccugaacugguaccagcagaagccggggaagggccccaagcuccugaucuacgacgcgagcaaccugcagcgcggggugcccucccgguucagcggcgggggcuccggcaccgacuucacccucaucaucagcucccugcagcccgaggacguggggaccuacuacugccagcaguacgacggccugccguucacguucgggggcgggaccaagcucgagaucaag

SEQ ID NO: 12333 - RNA, 321 nt, Artificial Sequence
  derived and/or modified sequence opt1 from anti-influenza_Chain
gacauccagcugacccagagccccuccagccucuccgccagcaucggcgaccgcgugaccaucacgugccaggccucccaggacauccggaacagccugaacugguacgagcacaagccggggaaggcgcccaagcugcucauccacgacgccuccaaccuggagaccggcguccccagccgcuucuccgggggcgggagcggcaccgacuucacccugacgaucuccagccuccagcccgaggacuucgccaccuacuacugccagcaggccaacuccuucccgcugaccuucggcgggggcaccaagguggagaucaag

SEQ ID NO: 12334 - RNA, 321 nt, Artificial Sequence
  derived and/or modified sequence opt1 from anti-influenza_Chain
gacauccagcugacccagagccccuccagccucuccgccagcgugggcgaccgcgucaccaucacgugccgggccucccaggggauccgcaacgaccugggcugguaccagcagaagccggggaacgcgcccaagcggcugaucuucggcgccagcucccuccagagcggggugcccucccgcuucagcggcuccggcagcgggaccgaguucacccugaccaucuccagccugcagcccgaggacuucgccacguacuacugccuccagcacaacuccuacccguacaccuucggccaggggaccaagcuggagaucaag

SEQ ID NO: 12335 - RNA, 321 nt, Artificial Sequence
  derived and/or modified sequence opt1 from anti-influenza_Chain
gacauccagcugacccagagccccuccagccucuccgccagcgugggcgaccgcgucaccaucacgugccgggccucccagagcaucucccgcuaccugaacugguaccagcagaagccggggaaggcgcccaagcugcuccuguucgccgccagcacccugcucgacggcgugcccucccgguucagcggguccggcagcgggaccgacuucacccugacgaucuccagccugcagcccgaggacuucgccaccuacuacugccagcgcaaccacuccccgagcuggaccuucggccagggcacccggguggagaucaag

SEQ ID NO: 12336 - RNA, 321 nt, Artificial Sequence
  derived and/or modified sequence opt1 from anti-influenza_Chain
gacauccagaugacccagagccccuccagccuguccgccagcgugggcgaccgcgucaccaugacgugccgggccucccagaacauccgcagcuaccucaacugguaccagcagcggccggggaccgcgcccaagcugcugaucuacgccgccuccacccuccacagcggcgugcccucccgcuucagcgggggcggguccggcaccgacuucacgcugaccaucaacaaccugcagcccgaggacuucgccagcuacuacugccagcaguccuacgacaacccgcagaccuucggccaggggaccaagguggagaucaag

SEQ ID NO: 12337 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccaaccaggacaucgggaucuaccucaacugguaccagcagaacccgggcaaggugcccaagcugcugcuccacggggcguccagccugcagggcggggugcccucccgcuucagcgccuccggcagcggcaccgacuucacccugaccauccacucccuccagcccgaggaccuggccacguacuacugccagcagagccggcgccugccguacaccuucgggcagggcacccgggucgagcucaag

SEQ ID NO: 12338 - RNA, 321 nt, Artificial Sequence
  derived and/or modified sequence opt1 from anti-influenza_Chain
gacauccagaugacccagagccccuccacccugagcgccuccaucggcgaccgcgugacgaucacgugccgggccagccaguccaucgcgagcuggcucgccugguaccagcagaagccggggaaggcccccaagcugcugaucuacgaggccgucaaccucgaguccggcgugcccagccgcuucuccgggagcggcuccgggaccgacuucacccugaccaucagcucccugcagcccgacgacuucgccaccuacuucugccagcacuacggcaccaucagccagaccuucggcgggggcacgaagguggagaucaag

SEQ ID NO: 12339 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucuccagcuaccucaacugguaccagcacaagccggggaaggcgcccaaggugcugauguacgccguguccauccugcagagcggcguccccucccgcuucagcggguccggcagcggggccgacuucacccucaccaucuccagccugcagcccgaggacuucgccaccuacuacugccagcaguccuacagcuccccgcugacguucggcggcgggaccaagguggagaucaag

SEQ ID NO: 12340 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagaacaucaagcgcuacuucaacugguaccagcagaagccggggaaggcgcccaagcuccugaucuacgccgccagcaaccuggagaacggcgugcccucccgguucagcggguccggcagcgggaccgacuucacccucaccaucuccagccugcagcccgaggacuucgccacguacuacugccagcaguccuucagcaaguccuggaccuucggccagggcaccaacguggacaucaag

SEQ ID NO: 12341 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagaacaucuacaaguaccucaacugguaccagcagcgcccggggaaggcgcccaagggccugaucagcgccgccuccgggcugcagagcggcgugcccucccgguucagcggguccggcagcggcaccgacuucacccucaccaucacgucccugcagcccgaggacuucgccaccuacuacugccagcagagcuacuccccgccccugaccuucgggggcgggacccgcguggagaucaag

SEQ ID NO: 12342 - RNA, 321 nt, Artificial Sequence
  derived and/or modified sequence opt1 from anti-influenza_Chain
gacauccagaugacccagagccccuccagccuguccagcuccgugggcgaccgcgucaccaucacgugccgggccagccaguccaucggggccuacgugaacugguaccagcagaaggcgggcaaggccccgcagguccucaucuucggggccagcaaccugcaguccggcgugcccagccgcuucuccgggagcggcuccggcaccgacuucacccugaccaucagcucccuccagcccgaggacuucgccacguacuucugccagcagaccuacagcacccccaucaccuucgggcagggcacgcggcuggagaucaag

SEQ ID NO: 12343 - RNA, 321 nt, Artificial Sequence
  derived and/or modified sequence opt1 from anti-influenza_Chain
gacauccagaugacccagagccccuccagccuguccgccagcgugggcgaccgcgucaccaucuccugccgggccagccaguccaucagcacguaccucaacugguaccagcagcagccggggaaggcgcccaaggugcugaucuucggcgccaccaaccugcaguccggggugcccagccgcuucuccggcagcggguccggcaccgacuucacccucacgaucagcucccugcagcccgaggacuucgccaccuacuacugccagcagagcuacaacaccccgcugaucuucggccaggggaccaagcucgagaucaag

SEQ ID NO: 12344 - RNA, 321 nt, Artificial Sequence
  derived and/or modified sequence opt1 from anti-influenza_Chain
gacauccagaugacccagagccccuccagccuguccgccagcgugggcgaccgcgucaccaucuccugccgggccagccaguccaucagcacguaccucaacugguaccagcagcagccggggaaggcgcccaaggugcugaucuccggcgccaccaaccugcagagcggggugcccucccgcuucagcggcuccgggagcggcaccgacuucacccucacgaucuccagccugcagcccgaggacuucgccaccuacuacugccagcaguccuacaacaccccgcugaucuucggccaggggaccaagcucgagaucaag

SEQ ID NO: 12345 - RNA, 321 nt, Artificial Sequence
  derived and/or modified sequence opt1 from anti-influenza_Chain
gacauccagaugacccagagccccuccagccuguccgccagcgugggcgaccgccucaccaucacgugccgggccucccagagcaucuccaccuaccugcacugguaccagcagaagccggggaaggcgcccaagcugcucaucuacgccgccagcucccugcagagcggcguccccucccgcuucagcgggucccggagcggcaccgacuucacccugacgaucuccagccuccagcccgacgacuucgccaccuacuacugccagcaguccuacagcccgccccugaccuucgggcccggcaccaagguggacaugaag

SEQ ID NO: 12346 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucuccaacuaccucaacugguaccagcacaagccgggggaggcgcccaagcugcugaacuacgccgccagcucccuccagagcggcgugcccucccgcuucagcgccuccgggagcggcaccgacuucacccugaccaucuccagccugcagcccgaggacuucgccacguacuacugccagcaguccuacaacaccccgaucaccuucgggcagggcacccggcucgagaucaag

SEQ ID NO: 12347 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucuccaacuaccucaacugguaccagcacaagccgggggaggcgcccaagcugcugaacuacgccgccagcucccuccagagcggcgugcccucccgcuucagcgccuccgggagcggcaccgacuucacccuguccaucagcgggcugcagcccgaggacuucgccaccuacuacugccagcaguccuacaacacgccgaucaccuucggccccggcacccggcucgagaucaag

SEQ ID NO: 12348 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagagcaucuccaccuaccucaacugguaccagcagaagccggggaaggcgcccaagcugcugaucuacgccgccagcucccuccacagcggcgugcccucccgcuucagcggguccggcagcgggaccgacuucgcccugaccaucuccagccugcagcccgaggacuucgccacguacuacugccagcaguccuacagcccgcccaucaccuucggccagggcacccggcucgagaucaag

SEQ ID NO: 12349 - RNA, 321 nt, Artificial Sequence
  derived and/or modified sequence opt1 from anti-influenza_Chain
gacauccagaugacccagagccccuccagccuguccgccagcgugggcgaccgcgucaccaucacgugccgggccucccagaccaucagcaccuaccucaacugguaccagcagaaguccgggaaggcgccgaagcugcugaucuacgccgccagcggccuccaguccggggugcccagccgcuucuccggcagcggguccggcaccgacuucacgcugaccaucagcucccugcagcccgaggacuucgccaccuacuucugccagcagagcuacaacacgccccucaccuucggccaggggaccaagguggagaucaag

SEQ ID NO: 12350 - RNA, 321 nt, Artificial Sequence
  derived and/or modified sequence opt1 from anti-influenza_Chain
gacauccagaugacccagagccccuccagccuguccgccagcgugggcgaccgcgucaccaucuccugccgggccagccaguccaucagcacguaccucaacugguaccagcagcagccggggaaggcgcccaaggugcugaucuccggcgccaccgaccugcagagcggggugcccucccgcuucagcggcuccgggagcggcaccgacuucacccucacgaucuccagccugcagcccgaggacuucgccaccuacuacugccagcaguccuacaacaccccgcugaucuucggccaggggaccaagcucgagaucaag

SEQ ID NO: 12351 - RNA, 321 nt, Artificial Sequence
  derived and/or modified sequence opt1 from anti-influenza_Chain
gacauccaggugacccagagccccuccagccuguccgccagcgucggcgaccgcgugaccaucacgugccgggccucccagaacaucuacaaguaccucaacugguaccagcagcgcccggggaaggcgcccaagggccugaucagcgccgccuccgggcugcagagcggcgugcccucccgguucagcggguccggcagcggcaccgacuucacccucaccaucacgucccugcagcccgaggacuucgccaccuacuacugccagcagagcuacuccccgccccugaccuucgggggcgggacccgcgucgacaucaag

SEQ ID NO: 12352 - RNA, 321 nt, Artificial Sequence
  derived and/or modified sequence opt1 from anti-influenza_Chain
cagagcgugcugacccagcccccguccgagagcgucucccccggccagaccgccagcgugacgugcuccgggcacaagcucggcgacaaguacgugagcugguaccagcagaagcccgggcagucccccguccugcugaucuaccaggacaaccgccggccgagcggcauccccgagcgcuucaucggguccaacagcggcaacaccgccacccucaccaucuccggcacgcaggcgcuggacgaggccgacuacuacugccaggccugggacagcuccaccgccguguucgggggcgggaccaagcugaccgugcucggc

SEQ ID NO: 12353 - RNA, 321 nt, Artificial Sequence
  derived and/or modified sequence opt1 from anti-influenza_Chain
gacauccagcugacccagagccccuccagccucuccgccagcgugggcgaccgcgucaccaucacgugccgggccucccaggggaucagcaccuaccuggcgugguaccagcagaagccgggcaaggugcccaagcugcucaucuacgccgccuccacccugcagagcggggugcccucccgcuucagcggcuccgggagcggcaccgacuucacgcugaccaucuccagccuccagcccgaggacgucgccaccuacuacugccagaaguacaacuccgccccgagcuucggccccgggaccaagguggacaucaagcgg

SEQ ID NO: 12354 - RNA, 321 nt, Artificial Sequence
  derived and/or modified sequence opt1 from anti-influenza_Chain
agcgugcugacccagcccccguccgccagcggcucccgcgggcagagcaucaccaucuccugcacgggcagcaccuccgacaucgggagcuacaacuacgucuccugguaccagcagcaccccggcaccgcccccaaggugauccucuacgaggugagccagcggcccuccggggucccggaccgcuucagcggcuccaagagcggcaacaccgcguuccugacgguguccgggcugcaggccgaggacgaggccgacuacuacugcgccagcuacgccggcaacaacaucuacguguucggguccggcaccaaggucacc

SEQ ID NO: 12355 - RNA, 321 nt, Artificial Sequence
  derived and/or modified sequence opt1 from anti-influenza_Chain
agcgcccugacccagcccccguccgccagcggcucccgcgggcagagcaucaccaucuccugcacgggcagcaccuccgacaucgggagcuacaacuacguguccugguaccagcagcaccccggcaccgcgcccaaggucauccucuacgaggugagccagcggcccuccggggugccggaccgcuucagcggcuccaagagcggcaacaccgccuuccugacggucuccgggcugcaggccgaggacgaggccgacuacuacugcgccagcuacgcgggcaacaacaucuacguguucggguccggcaccaaggugacc

SEQ ID NO: 12356 - RNA, 321 nt, Artificial Sequence
  derived and/or modified sequence opt1 from anti-influenza_Chain
gagaucgugcugacccagagccccgccacccucucccugagccccggcgagcgcgccacgcuguccugccgggcgagccaguccgucagcaccuuccucgccugguaccagcagaagcccgggcaggcgccccgccugcugauguacgacgccuccaaccgggccaccggcauccccgcccgcuucagcggguccggcagcgggaccgacuucacgcucaccaucuccagccuggagccggaggacuucgccaucuacuacugccagcagcggucccacuggccgcccaucuucggccagggcacccgccuggagaucaag

SEQ ID NO: 12357 - RNA, 321 nt, Artificial Sequence
  derived and/or modified sequence opt1 from anti-influenza_Chain
gacauccagaugacccagagccccgccucccugagcguguccgucggcgagaccgugaccaucacgugccgcgccagcgagaagaucuacuccaaccucgcgugguaccagcagaaggagggcaagagcccgcagcugcugguguacgccgccauccggcucgccgacgggguccccucccgcuucagcggguccggcagcgggacccaguucucccugaagaucaacagccugcaguccgaggacuucggcaccuacuacugccagcacuucuggggcacgccccucaccuucggggccggcaccaagcuggagcugaag

SEQ ID NO: 12358 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaaggcccccaagcuccugaucuacgccgccuccagccugcaguccggcgugcccagccgcuucuccgggagcggcuccgggaccgacuucacccucacgaucagcucccugcagcccgaggacuucgccaccuacuucugccagcaggcgaacagcuucccgcccaccuucggccagggcaccaagcuggagaucaag

SEQ ID NO: 12359 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaaggcccccaagcuccugaucuacgccgccuccagccugcaguccggcgugcccagccgcuucuccgggagcggcuccgggaccgacuucacccucacgaucagcucccugcagcccgaggacuucgccaccuacuucugccagcaggcgaacagcuucccgcccaccuucggcugcggcaccaagcuggagaucaag

SEQ ID NO: 12360 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaagugccccaagcuccugaucuacgccgccuccagccugcaguccggcgugcccagccgcuucuccgggagcggcuccgggaccgacuucacccucacgaucagcucccugcagcccgaggacuucgccaccuacuucugccagcaggccaacagcuucccgcccaccuucggccagggcaccaagcuggagaucaag

SEQ ID NO: 12361 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaaggcccccaagcuccugaucuacgccgccuccagccugcaguccggcgugcccagccgcuucuccgggagcggcuccgggaccgacuucacccucacgaucagcucccugcagcccgaggacuucgccaccuacuacugccagcaggcgaacagcuucccgcccaccuucggccagggcaccaagcuggagaucaag

SEQ ID NO: 12362 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaaggcccccaagcuccugaucuacgccgccuccagccugcaguccggcgugcccagccgcuucuccgggagcggcuccgggaccgacuucacccucacgaucagcucccugcagcccgaggacuucgccaccuacuacugccagcaggcgaacagcuucccgcccaccuucggcugcggcaccaagcuggagaucaag

SEQ ID NO: 12363 - RNA, 321 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaagugccccaagcuccugaucuacgccgccuccagccugcaguccggcgugcccagccgcuucuccgggagcggcuccgggaccgacuucacccucacgaucagcucccugcagcccgaggacuucgccaccuacuacugccagcaggccaacagcuucccgcccaccuucggccagggcaccaagcuggagaucaag

SEQ ID NO: 12364 - RNA, 321 nt, Artificial Sequence
  derived and/or modified sequence opt1 from anti-influenza_Chain
gagaucgugcugacccagagccccgccacccucucccugagccccggcgagcgcgccacgcuguccugccgggcgagccgcuccaucaccaccuuccucgccugguaccagcagaagcccgggcaggcgccccggcugcugaucuacgacgccagcaaccgcgccaccggcguccccgcccgguucuccgggagcggcuccgggacggacuucacccucaccaucaacagccuggagccggacgacuucgccaucuacuacugccagcagcgcgaccacuggccgcccaucuucggccagggcacccggcuggagaucaag

SEQ ID NO: 12365 - RNA, 321 nt, Artificial Sequence
  derived and/or modified sequence opt1 from anti-influenza_Chain
gagaucgugcugacccagagccccgccacccucucccugagccccggcgagcgcgccacgcuguccugccgggcgagccgcuccaucaccaccuuccucgccugguaccagcagaagcccgggcaggcgccccggcugcugaucuacgacgccagcaaccgcgccaccggcguccccgcccgguucuccgggagcggcuccgggacggacuucacccucaccaucaacagccuggagccggacgacuucgccaucuacuacugccagcagcgcgaccacuggccgcccaucuucggcugcggcacccggcuggagaucaag

SEQ ID NO: 12366 - RNA, 324 nt, Artificial Sequence
  derived and/or modified sequence opt1 from anti-influenza_Chain
gagaucgugcugacccagagccccggcacccucucccugagcccgggggagcgcgccacgcuguccugccgggccagccagaccgucuccagcuccuaccucgccugguaccagcagaagcccggccaggcgccccgccugcugaucuacggggccagcucccgggccaccggcauccccgaccgcuucagcggguccggcagcggcaccgacuucacgcucaccaucucccggcuggagccggaggacuucgccguguacuacugccagcaguacgggaacagccccuacaccuucggccaggggaccaagcuggagaucaag

SEQ ID NO: 12367 - RNA, 324 nt, Artificial Sequence
  derived and/or modified sequence opt1 from anti-influenza_Chain
gagaucgugcugacccagagccccggcacccucuccgucagcccgggggagcgcgccacgcuguccugccgggccagccaguccaucagcuccggcuaccuggccugguaccagcagaagcccgggcaggcgccccgccuccugaucuacggcgccagcucccgggccaccgggauccccgaccgcuucagcggcuccggcagcgggaccgacuucacccugacgaucucccggcucgagccggaggacuucgccguguacuacugccagcaguacggcaccagcccccagaccuucgggcagggcaccaagguggagaucaag

SEQ ID NO: 12368 - RNA, 324 nt, Artificial Sequence
  derived and/or modified sequence opt1 from anti-influenza_Chain
gaggugguccugacccagagccccggcacccucucccugagcccggggcagcgcgccacgcuguccugccgggccagccaguccgugagcuccagcuaccucgccugguaccagcagaagcccggccaggcgccccgccugcugaucuacgacgccuccaaccgggccaccgggauccccgaccgcuucagcggcuccgggagcggcaccgacuucacccucacgaucucccggcuggagccggaggacuucgccguguacuacugccagcaguacggcagcucccccuacaccuucgggcagggcaccaagcuggagaucaag

SEQ ID NO: 12369 - RNA, 324 nt, Artificial Sequence
  derived and/or modified sequence opt1 from anti-influenza_Chain
gacauccagcugacccagagccccuccagccucuccgccagcgugggcgaccgcgucaccaucacgugccgggccucccaggggaucaucaccuaccugaacugguaccagcagaagccgggcaaggcgcccaagcugcucaucuacgccaccuacagccugcagaacggggugcccucccgcuucagcggcuccgggagcggcaccgacuucacgcugaccaucuccagccuccagcccgaggacuucgccaccuacuacugccagcaguccuacagcucccugauguucaccuucggccaggggacgaagcuggacaucaag

SEQ ID NO: 12370 - RNA, 324 nt, Artificial Sequence
  derived and/or modified sequence opt1 from anti-influenza_Chain
gagaccgugcugacccagagccccggcacgcucucccugaccccgggggagcgcgccacccugagcugccgggucggccaguccgugagcgggucccaccucgccugguaccagcagaagcccggccaggcgccccgccugcugaucuacggggccagcucccgggccaccggcauccccgaccgcuucggcgggagcguguccggcacggacuucacccucaccaucagccggcuggagccggaggacuccgccgucuacuacugccagcaguacggggacagccgcuacaccuucggccaggggacgaagcuggagaucaag

SEQ ID NO: 12371 - RNA, 324 nt, Artificial Sequence
  derived and/or modified sequence opt1 from anti-influenza_Chain
gagaucgugcugacccagagccccggcacccucucccugagccccggggagcgcgccacgcuguccugccgggccagccaguccgucagcuccagccagcucgccugguaccagcagaagcccggccaggcgccccgccugaucaucuacggggccuccacccgggccaccggcauccccgaccgcuucagcggguccggcagcggcaccgacuucacgcugaccaucgggcggcucgagccggaggacuucgccguguucuucugccagcaguacuccaccagcccgcccaccuucggccaggggacgaagguggacuucaag

SEQ ID NO: 12372 - RNA, 324 nt, Artificial Sequence
  derived and/or modified sequence opt1 from anti-influenza_Chain
gacaucgugcugacccagagccccggcacccucucccugagcccgggggagcgcgccacgcuguccugccgggccagccaguccgucagcuccagcuaccucgcgugguaccagcagaagcccggccaggcgccccgccuggugauguacggggccgccacccgggccaccggcauccccgaccgcuucuccgggagcggcuccggcccggacuucacccugacgaucagccggcucgagcccgaggacuucgccauguacuacugccagcaguacgggaacucccccaucaccuucggccaggggacccgccuggagaucaag

SEQ ID NO: 12373 - RNA, 324 nt, Artificial Sequence
  derived and/or modified sequence opt1 from anti-influenza_Chain
gagaucgugcugacccagagccccgccacccucucccugagccccggcgagcgcgccacgcuguccugccgggcgagccaguccgucagcuccuaccucgccugguaccagcagaagcccgggcaggcgccccgccugcugaucuacgacgccagcaaccgggccaccggcauccccgcccgcuucuccgggagcggcuccgggaccgacuucacccucacgaucagcucccuggagccggaggacuucgccguguacuacugccagcagcggagccacuggccgcccaucaccuucggccagggcacccgccuggagaucaag

SEQ ID NO: 12374 - RNA, 324 nt, Artificial Sequence
  derived and/or modified sequence opt1 from anti-influenza_Chain
agcuacgagcugacccagcccccguccgugagcgucucccccggccagaccgcccgcaucacgugcagcggggacgcccuccccaagcagaacgcguacugguaccagcagaagcccggccaggccccggugcugcugaucuacaaggacuccgagcggcccagcgggauccccgagcgcuucuccggcagcuccagcgggaccaccgugacccucacgaucuccggcguccaggccgaggacgaggccgacuacuacugccagagcgccgacuccagcggcaccuccuggguguucgggggcgggaccaagcugaccgugcug

SEQ ID NO: 12375 - RNA, 324 nt, Artificial Sequence
  derived and/or modified sequence opt1 from anti-influenza_Chain
agcuacgugcugacccaggcccccuccgucagcguggccccgggccagaccgcgcgcaucacgugcgggggcaacgccaucggguccaagaaggugcacugguaccagcacaaggccggccaggcccccguccucgugguguacgacgacaccgaccggcccagcgggauccccgagcgcuucuccggcagcaacuccuggagcaccgccacccugacgaucaaccgggucgaggcgggcgacgaggccgacuacuacugccaggugugggacuucaccaucgaccacguggucuucgggggcgggaccaagcugaccgugcuc

SEQ ID NO: 12376 - RNA, 324 nt, Artificial Sequence
  derived and/or modified sequence opt1 from anti-influenza_Chain
gagaucgugcugacccagagccccggcacccucucccugagcccgggggagcgcgccacgcuguccugccgggccagccaguccgucagcuccagcuaccucgccugguaccagaagaagcccggccaggcgccccgccugcugaucuacggggccuccacccgggccaccggcauccccgaccgcuucaccgggagcggcuccggcacggacuucacccucagcaucucccggcuggagccggaggacuucgccguguacuacugccagcacuucgggaccagcguguucaccuucggcgggggcacgaaggucgagaucaag

SEQ ID NO: 12377 - RNA, 324 nt, Artificial Sequence
  derived and/or modified sequence opt1 from anti-influenza_Chain
gagaucgugaugacccagagccccgccacccuguccgucagcccgggcgagcgcgccacgcucuccugccgggcgagccaguccguggggaacagccuggccugguaccagcagcgccccggccaggcgccccggcugcucaucuacggggccuccacccgcgccaccggcaucccgccccgguucagcggguccggcagcggcaccgaguucacgcugaccaucuccagccugcagaccgaggacuucgccguguacuacugccagcaguacaucaacuggcgcccccucuccuucgggggcgggaccaaggucgagaucaag

SEQ ID NO: 12378 - RNA, 324 nt, Artificial Sequence
  derived and/or modified sequence opt1 from anti-influenza_Chain
caggagagcggcgccgagcuggugcggcccggggccuccgucaagcucagcugcaaggacuccggcuacaccuucaccacguacuggaugaacugggugaagcagcggccggagcaggggcuggaguggaucggccgcaucgaccccuacgacagcgagacccacuacaaccagaaguucaaggacaaggcgauccugaccguggacaaguccagcaacaccgccuacaugcagcucuccagccugacguccgaggacagcgccgucuacuacugcgugcgcgggggcuccaccguggccuacuucggcgucugggggcagggc

SEQ ID NO: 12379 - RNA, 324 nt, Artificial Sequence
  derived and/or modified sequence opt1 from anti-influenza_Chain
gagaucgugcugacccagagccccggcacccucucccugagcccgggggagcgcgccacccuguccugccgggccagccagcgcgucuccagcuaccucgcgugguaccagcagaagcccggccaggcgccccggcugcugaucuacggggccuccacccgcgccgccggcauccccgaccgguucagcggguccggcagcggcaccgacuucacccucacgaucucccgccuggagccggaggacagcgccguguacuacugccagcaguacgggcggacgccccugaccuucggcgggggcaccaagguggagaucaagcgc

SEQ ID NO: 12380 - RNA, 324 nt, Artificial Sequence
  derived and/or modified sequence opt1 from anti-influenza_Chain
gagaucgugaugacccagagccccggcacccugucccucagcccgggggagcgcgccacgcuguccugccgggccagccaguccgucagcuccagcuaccuggccugguaccagcagaagcccggccaggcgccccgccuccugaucuucggggccuccagccgggccaccggcauccccgaccgcuucuccgggagcggcuccggcaccgacuucacccugacgaucagccggcucgagccggaggacuucgccguguacuacugccagcaguacggguccagccugaccuucggcgggggcaccaagcuggagaucaagcgc

SEQ ID NO: 12381 - RNA, 324 nt, Artificial Sequence
  derived and/or modified sequence opt1 from anti-influenza_Chain
gagaucgugcuguaccagagccccggcacccucucccugagcccgggggagcgcgccacccuguccugccgggccagccagcgcgucuccagcuaccucgcgugguaccagcagaagcccggccaggcgccccggcugcugaucuacggggccuccacgcgcgccgccggcauccccgaccgguucagcggguccggcagcggcaccgacuucacccucaccaucucccgccuggagccggaggacagcgccguguacuacugccagcaguacgggcggacgccccugaccuucggcgggggcaccaagguggagaucaagcgc

SEQ ID NO: 12382 - RNA, 324 nt, Artificial Sequence
  derived and/or modified sequence opt1 from anti-influenza_Chain
gacaucgugcugacccaggcccccagcgucuccgugagcccgggccagaccgccuccaucacgugcagcggggaccgccucggcgagaaguucgcguccugguaccagcagaagcccgggcagagccccgugcuggucaucuacgaggacuccaagcggcccagcggcaucccggaccgcuucuccgggagcaacuccggcaacaccgccacccugaccaucagcggcacgcagaucauggacgagggggacuucuucugccaggccugggacuccagcaccgugguguucggcgggggcaccaagcucaccguccuggggcag

SEQ ID NO: 12383 - RNA, 324 nt, Artificial Sequence
  derived and/or modified sequence opt1 from anti-influenza_Chain
gacaucgagcugacccagagccccuccgugagcgucuccccgggccagaccgccagcaucacgugcuccggggacaagcucggcgacaaguucgugugcugguaccagcagaaggccgggcagagccccaucguggucaucuaccaggacgacaagcgccccuccggcauccccgagcgguucagcggguccaacagcggcaacaccgcgacccugaccaucuccggcacgcaggccauggacgaggccgacuacuucugccaggccugggacagcaccaccgugguguucgggggcgggaccaagcugacgguccucggccag

SEQ ID NO: 12384 - RNA, 324 nt, Artificial Sequence
  derived and/or modified sequence opt1 from anti-influenza_Chain
cagagcgugcugacccagcccccguccgccagcggcucccgcgggcagagcaucaccaucuccugcacgggcagcaccuccgacaucgggagcuacaacuacgucuccugguaccagcagcaccccggcaccgcccccaaggugauccucuacgaggugagccagcggcccuccggggucccggaccgcuucagcggcuccaagagcggcaacaccgcguuccugacgguguccgggcugcagaccgacgacgaggccgacuacuacugcgccagcuacgccggcaacaacaucuacguguucggguccggcaccaaggucacc

SEQ ID NO: 12385 - RNA, 327 nt, Artificial Sequence
  derived and/or modified sequence opt1 from anti-influenza_Chain
aacuucaugcugacccagccccacagcguguccgagagcccgggcaagaccgucacgaucuccugcaccgggagcggcgggaacaucgcccgcaacuacgugcagugguaccagcagcggcccggcuccgcccccgugaccgucauccucgaggacgacaagcgccccagcgggaucccggaccgguucuccggcagcaucgaccgcuccagcaacuccgcgagccugaccaucuccggccugcggacggaggacgaggcccucuacuacugccagagcuacgacgacuccgaccuggugguguucgggggcgggaccaagcugacc

SEQ ID NO: 12386 - RNA, 327 nt, Artificial Sequence
  derived and/or modified sequence opt1 from anti-influenza_Chain
augcuggagccccuccagauccugagcaucugcuccuucauccugagcgcccuccacuucauggccuggaccaucggccaccugaaccagaucaagcgcggggugaaccugaagauccagauccggaacccgaacaaggaggcgaucaaccgcgaggucuccauccuccggcacaacuaccagaaggagauccaggccaaggagaccaugaagaagauccugagcgacaacauggaggugcugggcgaccacaucguggucgaggggcucuccacggacgagaucaucaagaugggcgagaccgugcuggagguggaggagcugcag

SEQ ID NO: 12387 - RNA, 327 nt, Artificial Sequence
  derived and/or modified sequence opt1 from anti-influenza_Chain
gacauccgccugacccagagccccgccacccucuccgugagcccgggcgagcgggccacgcuguccugccgcgcgagccacuccgucagccggaaccuggccugguaccagcagaagcccgggcgcgcgccccggcuccugguguacgacaccuccagccgcgccaccggcauccccgcccgguucuccgggagcggcuccgggaccgaguucacgcugaccaucagcucccuccagagcgaggacuucgccguguacuacugccagcaguacaacaacuggccgcgcaccuucggccagggcaccaaggucgacaucaagcggacg

SEQ ID NO: 12388 - RNA, 327 nt, Artificial Sequence
  derived and/or modified sequence opt1 from anti-influenza_Chain
gagaucgugaugacccagagccccggcacccugucccucagcccgggggagcgcgccacgcuguccugccgggccagccaguccgucagcuccagcuaccuggccugguaccagcagaagcccggccaggcgccccgccuccugaucuacggggccuccacccgggccaccggcgugcccgaccgcuuccacgggggcggcagcgggaccgacuucacgcugaccaucucccggcucgagccggaggacuucgccguguacuacugccagcaguacgacaccagcuccggccugaccuucgggggcgggacgaaggucgagaucaag

SEQ ID NO: 12389 - RNA, 327 nt, Artificial Sequence
  derived and/or modified sequence opt1 from anti-influenza_Chain
gagaucgugaugacccaguuccccgccacccugagcgucucccccggcgagcgcgugacgcucagcugccgggccucccagagcguguccaacaaccuggcgugguaccagcagaagcccgggcagccgccccgccugcucaucuacgacgccagcacccgggccaccggcguccccgccaaguucuccgggaccggcagcgggacggaguucacccuguccaucagcucccugcagagcgaggacuucgccguguacuacugccagcaguaccacaacuggccgcccuccuacagcuucggccucggcaccaagcuggagaucaag

SEQ ID NO: 12390 - RNA, 327 nt, Artificial Sequence
  derived and/or modified sequence opt1 from anti-influenza_Chain
gagaucauccuggcccagagccccggcacccucucccugagcccgggggagcgcgccacccuguccugccgggcgagccaguucguguccacgcgcagccucgccugguaccagcagcggcccggccaggcgccccgccugcugaucuacggggccuccagccgggccaccggcauccccgaccgcuucuccgggagcggcuccggcaccgacuucacccucacgaucagccggcuggagccggaggacuucgccgucuacuacugccagcacuacggguacagcccccgcuacgccuucggccagggguccaagguggagaucaag

SEQ ID NO: 12391 - RNA, 327 nt, Artificial Sequence
  derived and/or modified sequence opt1 from anti-influenza_Chain
gagaucgugcugacccagucccccggcacccucucccugagcccgggggagcgcgccacgcuguccugccgggccagccacuucgucaacuaccgcucccucgcgugguaccagcagacccccggccaggugccccggcugcugaucuacggggccagcacccgcgccaccggcauccccgaccgguucuccgggagcggcuccggcacggacuucacccucaccaucagccgccuggagccggaggacuucgccguguacuucugccagcaguacgggggcagcccccgguacaccuucgggcagggcacgcgccuggagaucaag

SEQ ID NO: 12392 - RNA, 327 nt, Artificial Sequence
  derived and/or modified sequence opt1 from anti-influenza_Chain
gagaucgugcugacccagagccccggcacccucucccugagcccgggggagcgcgccacgcuguccugccgggccagccacuucgucaucggccgcgcgguggccugguaccagcagaagcccgggcaggcgccccggcuccugaucuacggcgccuccagccgcgccaccgggauccccgaccgguucuccggcagcggcuccgggaccgacuucacccugacgaucagccgccucgagaccgaggacuucgccguguucuacugccagcacuacggcuccagcccgcgguacgccuucgggcagggcaccaagcuggagaucaag

SEQ ID NO: 12393 - RNA, 327 nt, Artificial Sequence
  derived and/or modified sequence opt1 from anti-influenza_Chain
gagaucgugcugacccagagccccgccacccucucccugagccccggcgagcgcgccacgcuguccugccgggcgagccaguccgucgggaacuaccucgccugguaccagcagaagcccggccaggcgccccgccugcugaucuacgacagcuccaaccgggcccccgggaucccggcccgcuucagcggcuccgggagcggcaccgacuucacccucaccaucuccagccuggcccccgaggacuucgccguguacuacugccagcagcgguccaaguggccgcccauguacagcuucggccacgggacgaagcuggagaucaag

SEQ ID NO: 12394 - RNA, 327 nt, Artificial Sequence
  derived and/or modified sequence opt1 from anti-influenza_Chain
caggccguggucacccaggagcccagccugaccguguccccgggcgggacggugacccugaccugcggcagcuccaccgggcccgucacgagcggccacuaccccuacugguuccagcagaagcccgggcaggccccgcgcacccucaucuccgcgaccagcaacacccacuccuggacgcccgcccgguucagcggcucccugcucggcgggcgcgccgcccugacccugagcggcgcccagcccgaggacgaggcggacuacuacugcuuccucuccuacagcggggccuggguguucggcgggggcaccacccugacggugcug

SEQ ID NO: 12395 - RNA, 327 nt, Artificial Sequence
  derived and/or modified sequence opt1 from anti-influenza_Chain
gccauccagaugacccagagccccuccagccuguccgccagcgugggcgaccgcgucaccaucacgugccgggcgucccagaacauccgcagcuaccucaacugguaccagcagaagccggggaaggcccccaaccugcugaucuacggcaccaccucccucgagagcggggugcccucccgguucagcggcuccgggagcggcaccgacuucacgcugaccaucuccagccugcagcccgaggacuucgccaccuacuacugccagcaguccuaccacaccccgcagacguucggccaggggaccaagguggagaucaagcgcacc

SEQ ID NO: 12396 - RNA, 327 nt, Artificial Sequence
  derived and/or modified sequence opt1 from anti-influenza_Chain
gacauccagaugacccagagccccuccagccuguccgccagcgugggcgaccgcaucaccaucacgugccgggccucccaggggaucgacaacuaccucgcgugguuccagcagaagccgggcaagguccccgagcugcugaucuacgccgccagcacccuccaguccggggugcccagccgcuucuccggcagcggguccggcaccggcuucacccugacgaucagcucccugcagcccgaggacguggccaccuacuacugccagaaguacgacagcgccccgcucaccuucgggggcgggaccaaggucgacaucaagcggacg

SEQ ID NO: 12397 - RNA, 327 nt, Artificial Sequence
  derived and/or modified sequence opt1 from anti-influenza_Chain
gacauccagcugacccagagccccuccagccucuccgccagcgugggcgaccgcgucaccaucacgugccgggccucccaggggaucaccgacuaccuggcgugguaccagcagaagccgggcaccauccccaagcugcucaucuacgccgccagcacccugcaguccggggugcccagccgcuucuccggcgggggcuacggcacggacuucacccugaccaucagcucccuccagcccgaggacguggccaccuacuacugccagaaguacaacagcgccccgcugacguucgggggcgggaccaaggucgagaucaagcggacc

SEQ ID NO: 12398 - RNA, 327 nt, Artificial Sequence
  derived and/or modified sequence opt1 from anti-influenza_Chain
gacaucgugaugacccagagccccuucucccugagccucuccccgggcgagcgcgccacccugagcugccgggccucccagagcaucuccaacuaccuggccugguaccagcagaagcccgggcaggcgccccgccuccugaucuacgacagcuccaaccgggccacgggcguccccgcccgcuucagcggguccggcagcgggaccgacuucacccugaccaucuccagccucgagccggaggacuucgccguguacuacugccagcagcgguccaacuggauguacacguucggccagggcaccaagguggagaucaagcgcacc

SEQ ID NO: 12399 - RNA, 327 nt, Artificial Sequence
  derived and/or modified sequence opt1 from anti-influenza_Chain
gacauccagaugacccagagccccuccagccuguccgccagcgugggcgaccgcgucaccaucacgugccgggccucccaggggaucagcuccuaccucgcgugguaccagcagaagccgggcaaggugcccacccugcugaucuacgacgccagcacccuccgcuccggggugcccagccgguucuccggcagcggguccgccaccgacuucacgcugaccaucagcucccugcagcccgaggacgucgccaccuacuacugccagcgcuacaacagcgccccgcccaucaccuucggccagggcacgcggcucgagaucaagcgc

SEQ ID NO: 12400 - RNA, 327 nt, Artificial Sequence
  derived and/or modified sequence opt1 from anti-influenza_Chain
gagaucgugaugacccagagccccggcacccugucccucagcccgggggagcgcgccacgcuguccugccgggccagccaguccgucagcuccagcuaccuggccugguaccagcagaagcccggccaggcgccccgccuccugaucuacgacgccuccagccgggccaccgacauccccgaccgcuucuccgggagcggcuccgggaccgacuucacccugacgaucagccggcucgagccggaggacuucgccguguacuacugccagcaguacggcuccagccuguggaccuucggccaggggaccaagguggagaucaagcgc

SEQ ID NO: 12401 - RNA, 327 nt, Artificial Sequence
  derived and/or modified sequence opt1 from anti-influenza_Chain
agcuacgugcugacccagcccccguccgucagcguggcccccggccagaccgcccgcaucacgugcgggggcaacaacaucggguccaagagcgugcacugguaccagcagaagcccggccaggcgcccguccucgugguguacgacgacuccgaccggccgagcgggauccccgagcgcuucuccggcagcaacuccggcaacaccgccacccugaccaucagccgggucgaggccggggacgaggccgacuacuacugccaggugugggacuccagcuccgaccacgccguguucggcgggggcacgcagcugaccguccucggg

SEQ ID NO: 12402 - RNA, 327 nt, Artificial Sequence
  derived and/or modified sequence opt1 from anti-influenza_Chain
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcccccgcaccuucggcgggggcaccaagguggagaucaagcgg

SEQ ID NO: 12403 - RNA, 327 nt, Artificial Sequence
  derived and/or modified sequence opt1 from anti-influenza_Chain
agcuacgugcugacccagcccccguccgucagcguggcccccggccagaccgcccgcaucacgugcgggggcaacaacaucggguccaagggcgugcacugguaccagcagaagcccgggcaggcgcccguccucgugguguacgacgacagcgaccggccguccggcauccccgagcgcuucagcggcuccaacagcgggaacaccgccacccugaccaucucccgggucgaggccggcgacgaggccgacuacuacugccaggugugggacagcuccagcgaccacguggucuucgggggcgggacgaagcugaccgugcucggc

SEQ ID NO: 12404 - RNA, 327 nt, Artificial Sequence
  derived and/or modified sequence opt1 from anti-influenza_Chain
gagaucgugcugacccagucccccggcacccucucccugagcccgggggagcgcgccacgcuguccugccgggccagccaguccgucagcuccaacuaccucggcuggacccagcagaagcccgggcaggcgccccgccugcugaucuacggcgccagcucccgggccagcgggauccccgaccgcuucuccggcggcgggagcggcaccgacuucacccucacgaucucccggcuggagccggaggacuucgccguguacuacugccagcaguacgggagcagcccccugaccuucggcgggggcaccaagguggagaucaagcgc

SEQ ID NO: 12405 - RNA, 327 nt, Artificial Sequence
  derived and/or modified sequence opt1 from anti-influenza_Chain
cagagcguggucacccagcccccguccgugagcguggcccccggccagaccgcccgcaucacgugcgggggcaacaacaucggguccaagagcguccacugguaccagcagaagcccggccaggcgcccgugcugguggucuacgacgacuccgaccggccgagcgggauccccgagcgcuucuccggcagcaacuccggcaacaccgccacccucaccaucagccggguggaggccggggacgaggccgacuacuacugccaggugugggacuccagcuccgaccacuacgucuucggcacggggaccaaggugaccgugcugggc

SEQ ID NO: 12406 - RNA, 327 nt, Artificial Sequence
  derived and/or modified sequence opt1 from anti-influenza_Chain
agcuacgugcugacccagcccccguccgagagcgucgcccccggccagaccgcccgcaucacgugcgggggcaacaacaucgggcggaacuccgugcacugguaccagcagaagcccggccaggcgcccgugcucgucguguacgacgacagcgaccgcccguccgggauccccgagcgguucagcggcuccaagagcggcaacaccgccacccugaucaucucccgcguggaggucggggacgaggccgacuacuacugccagguguggcacagcuccagcgaccacuacguguucggcaccgggacgaaggucaccgugcugggc

SEQ ID NO: 12407 - RNA, 327 nt, Artificial Sequence
  derived and/or modified sequence opt1 from anti-influenza_Chain
gagaucgugaugacccagagccccggcacccugucccucagcccggggcagcgcgccacgcuguccugccgggccagccaguccgucagcuccagcuaccuggccugguaccagcagaagcccggccaggcgccccgccuccugauguacggggccuccagccgggccaccggcauccccgaccgcuucuccgggagcggcuccggcaccgacuucacccugacgaucagccggcucgagccggaggacuucgccguguacuacugccagcaguacggguccagcucccugaccuucggcgggggcaccaagcuggagaucaagcgc

SEQ ID NO: 12408 - RNA, 327 nt, Artificial Sequence
  derived and/or modified sequence opt1 from anti-influenza_Chain
caggccggccugacccagcccccgagcguguccgucgcccccgggcagaccgcgcgcaucacgugcggcgggaacaacaucggcagcaaguccgugcacugguaccagcagaagcccgggcaggcccccgugcucgucguguacgacgacagcgaccggccguccggcauccccgagcgcuucagcggcuccaacagcgggaacaccgccacccugaccaucucccggguggaggccggcgacgaggccgacuacuacugccaggucugggacagcuccagcgaccacgugguguucgggggcgggacgaagcugaccguccucggc

SEQ ID NO: 12409 - RNA, 327 nt, Artificial Sequence
  derived and/or modified sequence opt1 from anti-influenza_Chain
cagagcguggucacccagcccccguccgagagcguggcccccggccagaccgcccgcaucacgugcgggggccacaacaucggguccaacagcgugcacugguaccagcagaagcccggccaggcgcccguccuggugguguacgacaacuccgaccggccgagcgggauccccgagcgcuucuccggcagcaacuccggcaacaccgccacccucaccaucagccgggucgaggccggggacgaggccgacuacuacugccagguguggggcuccagcuccgaccacuacguguucgggacgggcaccaaggucaccgugcugggg

SEQ ID NO: 12410 - RNA, 327 nt, Artificial Sequence
  derived and/or modified sequence opt1 from anti-influenza_Chain
gagaucgugcugacccagucccccggcacccucucccugagcccgggggagcgcgccacgcuguccugccgggccagccaguccgucagcuccaacuaccucggcugguaccagcagaagcccgggcaggcgccccgccugcugaucuacggcgccagcucccgggccagcgggauccccgaccgcuucuccggcggcgggagcggcaccgacuucacccucaccaucucccggcuggagccggaggacuucgccguguacuacugccagcaguacgggagcagcccccugacguucggcgggggcaccaagguggagaucaagcgc

SEQ ID NO: 12411 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuggccgccccggcugaccuucggcggcggguccaagguggagaucaag

SEQ ID NO: 12412 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuacccgccccggcugaccuucggcggcggguccaagguggagaucaag

SEQ ID NO: 12413 - RNA, 327 nt, Artificial Sequence
  derived and/or modified sequence opt1 from anti-influenza_Chain
gagaucgugaugacccagagccccgccacccuguccgucagcccgggcgagcgcgccacgcucuccugccgggcgagccaguccguggacagcaaccuggccugguaccagcagaagcccgggcaggcgccccgccugcucguguacuccgccagcacccgggccaccggcauccccgcccgcuucuccgggagcggcuccgggaccgaguucacgcuggccaucagcucccugcagagcgaggacuucgccgucuacuacugccagcacuacaccaacuggccgccccggcucaccuucggcggcggguccaagguggagaucaag

SEQ ID NO: 12414 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagcuccaaccuggccugguaccagcagaagcccgggcaggcgccccgccuccugguguacagcgccuccacccgggccaccggcauccccgcccgcuucagcggguccggcagcgggaccgaguucacgcuggccaucuccagccuccaguccgaggacuucgccgucuacuacugccagcacuacaccaacuggccgccccggcugaccuucggcggcgggagcaagguggagaucaag

SEQ ID NO: 12415 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggaccacaaccuggccugguaccagcagaagcccgggcaggcgccccgccuccugguguacagcgccuccacccgggccaccggcauccccgcccgcuucagcggguccggcagcgggaccgaguucacgcuggccaucuccagccuccaguccgaggacuucgccgucuacuacugccagcacuacaccaacuggccgccccggcugaccuucggcggcgggagcaagguggagaucaag

SEQ ID NO: 12416 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuggccgccccggcugaccuucggcggcggguccaagguggagaucaag

SEQ ID NO: 12417 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuucccgccccggcugaccuucggcggcggguccaagguggagaucaag

SEQ ID NO: 12418 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuucccgccccggcugaccuucggcggcggguccaagguggagaucaag

SEQ ID NO: 12419 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuacccgccccggcugaccuucggcggcggguccaagguggagaucaag

SEQ ID NO: 12420 - RNA, 327 nt, Artificial Sequence
  derived and/or modified sequence opt1 from anti-influenza_Chain
gagaccacccugacgcagagccccgccacccucuccgugagcccgggcgagcgcgccacccuguccugccgggcgagccaggucaucucccacaaccuggccugguaccagcagaagcccgggcaggcgccccgccuccugaucuacggcgccagcacccgggccuccgggauccccgcccgcuucagcggcuccgggagcggcacggacuacacccugaccaucaccucccuccagagcgaggacuucgccguguacuacugccagcacuacuccaacuggccgccccggcugacguucggcgggggcaccaagguggagaucaag

SEQ ID NO: 12421 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuggccgccccggcugaccuucggcgggggcaccaaggucgagaucaag

SEQ ID NO: 12422 - RNA, 327 nt, Artificial Sequence
  derived and/or modified sequence opt1 from anti-influenza_Chain
gagaucgugcugacccagagccccgccacccucuccgucagccccggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagccggaggacuucgccguguacuacugccagcacuacagcaacuggccgccccggcugaccuucggcgggggcaccaaggucgagaucaag

SEQ ID NO: 12423 - RNA, 327 nt, Artificial Sequence
  derived and/or modified sequence opt1 from anti-influenza_Chain
gagaucgugaugacccagagccccgccacccuguccgucagcccgggcgagcgcgccacgcucuccugccgggcgagccaggugaucucccacaaccuggccugguaccagcagaagcccgggcaggcgccccgccugcucaucuacggcgccagcacccgggccuccgggauccccgcccgcuucagcggcuccgggagcggcaccgacuacacccugacgaucaccucccugcagagcgaggacuucgccguguacuacugccagcacuacuccaacuggccgccccggcucaccuucggcgggggcaccaaggucgagaucaag

SEQ ID NO: 12424 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuucccgccccggcugaccuucggcgggggcaccaaggucgagaucaag

SEQ ID NO: 12425 - RNA, 327 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuacccgccccggcugaccuucggcgggggcaccaaggucgagaucaag

SEQ ID NO: 12426 - RNA, 327 nt, Artificial Sequence
  derived and/or modified sequence opt1 from anti-influenza_Chain
gagaucgugcugacccagagccccgccacccucuccgucagcccgggcgagcgcgugacgcuguccugccgggccagccaguccguggcgaacaaccuggccugguaccagcagaagcccgggcagagcccccgccuccugaucuacggcgccuccacccgggacaccgggauccccgcccgcuucagcggcuccgggagcggcaccgaguucacgcugaccaucuccagccuccaguccgaggacuucgccgucuacuacugccagcaguacaacaacuggccgcccauguacaccuucggccaggggaccaagcuggagaucaag

SEQ ID NO: 12427 - RNA, 327 nt, Artificial Sequence
  derived and/or modified sequence opt1 from anti-influenza_Chain
gacaucgugaugacccagagccccuccacccugagcgccuccgucggcgaccgcgugacgaucacgugccgggccagccaguccaucgggaacuggcucgcgugguaccagcagaagccgggcaaggcccccaagcugcugaucuacaaggugagcacccucgaguccgggguccccagccgcuucuccggcagcggguccggcaccgaguucacccugaccaucaacagccugcagcccgacgacuucgccaccuacuacugccagcgguacaccuccaacagccagggcuucacguucgggcagggcaccaagcucgagaucaag

SEQ ID NO: 12428 - RNA, 327 nt, Artificial Sequence
  derived and/or modified sequence opt1 from anti-influenza_Chain
gacaucgugaugacccagagccccgccacccuguccgucagcccgggcgagcgcgccacgcucuccugccgggcgagccaggugguggggaccaaccuggccugguaccagcagaagcccggccaggcgccccgccugcucaucuacgccgccuccacccgggccaccgggauccccgcccgcuucagcggcuccggguucggcacggacuucacccugaccaucagcucccugcagagcgaggacuucgccgucuacuacugccagcaguacaacaacuggccgcucuccuucggcgggggcaccaagguggagauccggcgcacg

SEQ ID NO: 12429 - RNA, 327 nt, Artificial Sequence
  derived and/or modified sequence opt1 from anti-influenza_Chain
gacauccagaugacccagagccccuccagccuguccgccagcgugggcgaccgcgucaccaucgugugccgggccucccaggggaucaacacgcaccuccacugguaccagcagaagccgggcaaggcgcccaagcugcugaucuacagcgccuccacccuccacaccggggugcccagccgccuguccggcagcggguccggcaccgacuucacgcugagcaucuccagccuccagcccgaggacuucgccaccuacuacugccagcaguccuacaacuacccgcggaccuucggccaggggaccaacgucgacaucaagcgcacg

SEQ ID NO: 12430 - RNA, 327 nt, Artificial Sequence
  derived and/or modified sequence opt1 from anti-influenza_Chain
gacauccugaugacccagagccccuccagccucuccgccagcgugggcgaccgcgucaccaucacgugccgggccucccaggacauccgcaaccggcuggcgugguaccagcagaagccggggaaggcccccaagcgccugaucuacgccgccagcucccuccagagcggcgugcccucccgguucagcggguccggcagcgggaccgaguucacccugaccaucaacucccugcagcccgaggacuucgccacguacuacugccuccagcacaacagcuacccguggaccuucggccccggcaccaagguggagaucaagcgcacc

SEQ ID NO: 12431 - RNA, 327 nt, Artificial Sequence
  derived and/or modified sequence opt1 from anti-influenza_Chain
gacaucgugaugacccagagccccgccacccuguccgucagcccgggcgagggggccacgcucuccugccgcgcgagccagggcaucggguccaaccuggccugguaccagcacaagcccggccaggcgccccggcugcucaucuacgccgccagcacccgcgccaccggggugcccgcccgguucuccggcagcggcuccgggaccgaguucacgcugaccaucagcucccugcagagcgaggaccucgccguguacuucugccagcaguacaacaccuggccgcugaccuucggcgggggcacgaaggucgagaucauccgcacc

SEQ ID NO: 12432 - RNA, 327 nt, Artificial Sequence
  derived and/or modified sequence opt1 from anti-influenza_Chain
gacaucgugaugacccagagccccuccacccugagcgccuccgucggcgaccgcgugacgaucacgugccgggccagccagaccaucuaccgcuggcucgcgugguaccagcagaagccggggaaggcccccaaggugcugaucuacaaggccuccacccuggagagcggcguccccucccgguucagcggguccggcagcgggaccgaguucacccucgccaucuccagccugcagcccgacgacuucgccaccuacuacugccagcaguacaacuccuucccguaccgcuucggccagggcaccaagguggagaucaagcggacg

SEQ ID NO: 12433 - RNA, 327 nt, Artificial Sequence
  derived and/or modified sequence opt1 from anti-influenza_Chain
gacaucgugaugacccagagccccuccagccuguccgccagcgucggcgaccgcguguccaucacgugccgggccagccagaccaucacccgcuuccucaacugguaccagcagaagccggggaagggccccaagcugcugaucuacgcggccuccaccgugcaccgcgggguccccagccgguucuccggcagcggguccggcaccgacuucacgcucaccaucagcucccugcagcccgaggacuucgccaccuacuacugccagcagagcuacuccgccccguucaccuucggccccgggacgaccguggacauccggcgcacc

SEQ ID NO: 12434 - RNA, 327 nt, Artificial Sequence
  derived and/or modified sequence opt1 from anti-influenza_Chain
gacaucgugaugacccagcccccggccacccugagcgucucccccggcgagcgcgccacgcucagcugcggggcgucccagggccuggggagcaaccuggccugguaccagcagaagcccggccaggcgccccggcuccugaucuacgccgccuccacccgcgccaccgggaucaccgcccgguucagcggcuccggcagcgggacggaguucacccugaccaucaacucccuccagagcgaggacuucgcccuguacuacugccagcaguacaccuacuggccgcugacguucggcgggggcaccaagguggagaucaagcgcacc

SEQ ID NO: 12435 - RNA, 327 nt, Artificial Sequence
  derived and/or modified sequence opt1 from anti-influenza_Chain
gacaucgugcugacccagagccccgccacccucuccgucagccccggcgagcgcgccacgcuguccugccgggcgagccaguccgugaaccgcaaccuggccugguuccagcagauccccgggcaggcgccccggcuccugaucuucgacgccagcacccgcgccgccgacauccccgcccgguucuccggcgggggcagcggggccgaguucacccugaccguguccagccuccagccggaggacuucgccgucuacuacugccagcaguacgacaaguggccgcccggcuucggccaggggacgaagguggagaucaagcgcacc

SEQ ID NO: 12436 - RNA, 330 nt, Artificial Sequence
  derived and/or modified sequence opt1 from anti-influenza_Chain
cagagcgugcugacccagcccccguccgccagcggcgcccccgggcagcgcgucacccucuccugcagcggcuccgggagcaacaucggcuccaacacggugagcugguaccagcagcugcccgggaccgcgcccaagcugcucguguucaccaacaaccagcggccguccggcguccccgaccgcuucagcggcuccaagagcgggaccuccgccagccuggccaucuccggccugcagagcgaggacgaggccgacuacuacugcgccgcgugggacgacucccucaacgggcagcuguucggcgggggcacgaagcugaccgugcuc

SEQ ID NO: 12437 - RNA, 330 nt, Artificial Sequence
  derived and/or modified sequence opt1 from anti-influenza_Chain
cagagcgugcugacccagcccccguccgucagcgccgcccccggccagcgcgugaccaucuccugcagcgggacguccagcaacaucggcaagaacuacguguccugguaccagcagcuccccggggcggcccccaagcugcugaucuacgacaacgacaagcggccgagcggcauccccgaccgcuucuccgggagcaaguccggcaccagcgccacccucggcaucaccgggcugcagacgggcgacgaggccgacuacuacugcgggaccugggacuccagccuguccgucggcauguucgggggcggcacccggcucaccgugcug

SEQ ID NO: 12438 - RNA, 330 nt, Artificial Sequence
  derived and/or modified sequence opt1 from anti-influenza_Chain
gagaccacccugacgcagagccccgccacccucuccgugagcccgggcgagcgcgccacccuguccugccgggcgagccaguccgucagccgcaaccuggccugguaccagcagaagcccgggcaggcgccccggcuccugaucuacggcgccuccagccgcgccaccgggauccccgaccgguucuccggcagcggguccggcacggacuucacccugaccaucagccgccucgagccggaggacuucgccguguacuacugccagcaguacggcuccagcuccaucaccuucgggcagggcacgcggcuggagaucaagcgcaccgug

SEQ ID NO: 12439 - RNA, 330 nt, Artificial Sequence
  derived and/or modified sequence opt1 from anti-influenza_Chain
cagagcgugcugacccagcccccguccgccagcggcacccccgggcagcgcgucacgaucuccugcagcggcuccagcuccaacaucgggagcaacaccgugaacugguacaagcagcuccccggcaccgcgccccggcugcugaucuacuccaacgaccagcgcccgagcggggugcccgaccgguucuccggcagcaaguccggcaccagcgccucccucgccaucagcgggcugcaguccgaggacgaggccaacuacuacugcgccgccugggacgacagccuguccggcugggucuucgggggcgggacgaagcucaccgugcug

SEQ ID NO: 12440 - RNA, 330 nt, Artificial Sequence
  derived and/or modified sequence opt1 from anti-influenza_Chain
cagagcgcccugacccagccccgcuccgugagcggcuccccggggcagagcgucaccaucuccugcacgggcagcuccagcgacgugggggccuccaacagcguguccugguaccagcagcaccccggcaaggcgcccaagcucgucaucuacgacgugaccgagcggcccagcggggugccgcaccgcuucuccggcagcaaguccggcaacaccgccagccugaccgucuccgggcugcagcccgaggacgaggccgacuacuucugcugcgccuacggcgggaaguaccucgugguguucggcgggggcacgaaggucaccgugcug

SEQ ID NO: 12441 - RNA, 330 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucgggggcuacaacuacgugagcugguaccagcagcaccccgggaaggcgcccaagcuccugaucuacgaggugaccaacuggcccuccggcgucagcaaccgcuucuccggcagcaaguccgggaacaccgccagccugacgaucuccggccuccaggccgaggacgaggccgacuacuacugcagcuccuacgccgggagcuccaccuggguguucggcgggggcacccgggugaccguccug

SEQ ID NO: 12442 - RNA, 330 nt, Artificial Sequence
  derived and/or modified sequence opt1 from anti-influenza_Chain
cagaccguggucacccaggagcccagccugacgguguccccgggcgggaccgugacccugaccugcgccagcuccacgggcgccgucaccagcuccuacuuccccaacugguuccagcagaagcccgggcaggcgccccgcccgcucaucuacagcaccaccauccggcacuccuggacgcccgcccgcuucagcggcucccugcucgggggcaaggccgcccugacccugagcggcgugcagcccgaggacgaggccgacuacuacugccuccuguacuccgggggcgaccccguggcguucgggggcgggaccaagcugaccguccuc

SEQ ID NO: 12443 - RNA, 330 nt, Artificial Sequence
  derived and/or modified sequence opt1 from anti-influenza_Chain
cagagcgugcugacccagucccccagcgucuccgccgccccgggccagaaggugaccaucagcugcuccgggagcgacuccaacaucggcgacuacuucgugugcugguaccagcaccuccccgggaagccgccccagcugcugaucuacgagaacaacaagcgccccagcggcauccccgaccgguucuccgggagcaaguccggcacgagcgcgacccucggcaucaccgggauccagaccggcgacgaggccgacuacuacugcgccacgugggacgggucccugagcgccugggucuucggcgggggcaccaagcugaccgugcuc

SEQ ID NO: 12444 - RNA, 330 nt, Artificial Sequence
  derived and/or modified sequence opt1 from anti-influenza_Chain
cagagcgcccugacccagccccgcuccgugagcggcuccccggggcagagcaucaccaucuccugcacgggcgggagcuccgacaucggcgccagcaacuccgucagcugguaccagcagcaccccgggaaggcgcccaagcucgugaucuucgacgugaccgagcggcccuccggcgucccgcaccgcuucagcggcuccaagagcgggaacaccgccucccugaccgugagcggccugcagcccgacgacgaggccgacuacuucugcugcgccuacgggggcaaguaccucguggucuucgggggcggcacgaaggugaccgugcug

SEQ ID NO: 12445 - RNA, 330 nt, Artificial Sequence
  derived and/or modified sequence opt1 from anti-influenza_Chain
caggccguggucacccaggagcccagccuggccguguccccgggcgggaccgugacgcugaccugcggcagcuccaccggggcggucacccgcggccacuaccccuacugguuccagcagaagcccgggcaggcgccccgggcccucaucuacgacagcgccggcaaccgccacuccuggacgccggcccgguucagcggcucccugcucgggggcaaggccgcccugacccugagcggggcccagcccgaggacgaggccgaguacuacugccuccuguccuacagcggcguguggguguucgggggcggcaccaagcugaccguccuc

SEQ ID NO: 12446 - RNA, 330 nt, Artificial Sequence
  derived and/or modified sequence opt1 from anti-influenza_Chain
gagaucgugaugacccagagccccgccacccuguccgucagcccgggcgagcgcgugacgcucuccugccgggccagccaguccaucaccgacgggcuggcgugguaccagcagaaguccggccaggcgccccgccugcucaucuacggggccagcacccgggccaccggcauccccgcccgcuucagcggguccggcagcggcacggaguucacccugaccaucuccagccugcaguccgaggacuucgccguguacuacugccagcaguacaacaacuggcccccggucaccuucgggcagggcacgaagguggagaucaagcggacc

SEQ ID NO: 12447 - RNA, 330 nt, Artificial Sequence
  derived and/or modified sequence opt1 from anti-influenza_Chain
agcuccgagcugacccagcccccgagcgccuccggcacccccgggcagcgcgugacgaucagcugcuccggcagcaccuccaacaucggguacaaccccgucagcugguaccagcagguccccggcaccgccccgaagcuccugaucuacuccaacaccgagcggcccagcggggugcccgaccgcuucuccggcagcaaguccggcacgagcgcgucccuggccaucagcgggcuccaguccgaggacgaggccgacuacuacugcgccgccugggacgacacccugaacggccccguguucgggggcgggaccaaggugaccgugcug

SEQ ID NO: 12448 - RNA, 330 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucgggggcuacaacuacgugagcugguaccagcagcaccccggggaggcgcccaagcucaugaucuccgacgugagcaaccgccccuccggcgucagcaaccgguucuccggcagcaaguccgggaacaccgccagccugaccaucuccggccugcaggccgaggacgaggccgacuacuacugcacgagcuacaccuccagcaacacccucguguucgggggcgggaccaagcugacggugcug

SEQ ID NO: 12449 - RNA, 330 nt, Artificial Sequence
  derived and/or modified sequence opt1 from anti-influenza_Chain
cagagcgugcugacccagcccccguccgucagcgccgcccccggccagaaggugaccaucuccugcagcggguccagcuccaacaucggccacaacuucgugagcugguaccagcagcuccccgcgacggcccccaagcugcugaucuacgacaccgacaagcgcccguccgggauccccgaccgguucagcggcuccaagagcgggaccuccgccacccucggcaucacgggccugcagaccggggacgaggccgacuacuacugcggcaccugggacagcucccugagcuccgucaucuucgggggcgggaccaagcucacggugcug

SEQ ID NO: 12450 - RNA, 330 nt, Artificial Sequence
  derived and/or modified sequence opt1 from anti-influenza_Chain
gacauccagaugacccagagccccuccacccugagcgccuccgugggcgaccgcgucacgaucacgugccgggccagccagaccaucaacaacuaccucgcgugguaccagcagaagccggggaaggcccccaagcugcugaucuacaaggccuccagccucgaguccggcgugcccagccgcuucuccgggagcggcuccgggaccgaguucacccugaccaucagcucccugcagcccgacgacuucgccaccuacuacugccaggaguacaacaacgacagcccgcucaccuucggcggcgggacgaagguggagaucaagcggacc

SEQ ID NO: 12451 - RNA, 330 nt, Artificial Sequence
  derived and/or modified sequence opt1 from anti-influenza_Chain
gacaucgagcugacccaggaccccagcguguccgucgccccgggccagaccgcccgcauccccugcgugcgguucaacauggggcccacgagcgugcacugguaccagcagaagcccggccaggcgccgguccucgugguguacgacgacuccgaccgccccagcgggauccccgagcgguucuccggcagcaacuccggggacagcgccacccugaccaucucccgcgucgaggccggcgacgaggccgacuacuacugccaggugugggacaugagcuccgaccggcgcguguucggcgggggcaccacgcugaccguccucgggcag

SEQ ID NO: 12452 - RNA, 330 nt, Artificial Sequence
  derived and/or modified sequence opt1 from anti-influenza_Chain
gacaucgugaugacccagagccccggcacccugucccucagcccgggggagcgcgccacgcuguacugccgggccucccagagcguccgcuccggcuaccuggccugguaccagcacaagcccgggcaggcgccccuccugcuguucuacgacgccagcggccgggccaccgggauccccgaccgcuucuccggcagcggcuccgggaccgacuucacccucacgaucagccggcuggagccggaggacuucgccguguacuacugccugcaguacggcuccagcccccgcaccuucgggcagggcaccaagguggagaucaagcggacc

SEQ ID NO: 12453 - RNA, 330 nt, Artificial Sequence
  derived and/or modified sequence opt1 from anti-influenza_Chain
gacaucgugcugacccagagccccuccuuccucagcgccuccgucggcgaccgcgugaccaucacgugccgggccagccagcugaucuccagcuacuucgcgugguaccagcagaagcccgggaagccgcccaagcugcucaucuacgccgccuccacccugcagagcggcgugcccucccgcuucagcggguccggcagcgggacccaguucucccugaccaucagcucccuccagcccgaggacuucgccacguacuacugccagcagcugaacagcuacccgcccaucaccuucggccagggcacccggcuggagaucaagcgcacc

SEQ ID NO: 12454 - RNA, 330 nt, Artificial Sequence
  derived and/or modified sequence opt1 from anti-influenza_Chain
gacaucacccugacccagagccccgccacgcucuccgugagcccgggcgagcgcgccacccuguccugccgggcgagccaguccgucagcuccaaccuggccugguaccagcagaagcccgggcaggcgccccgccuccugaucuacggcgccagcaaccgggccaccgacauccccgcccgcuucuccgggagcggcuccgggaccgaguucacgcugaccaucagcucccuccagagcgaggacuucgccguguacuacugccagcaguucaacgacuggccguuccugaccuucggcggcgggaccaagguggagaucaagcggacg

SEQ ID NO: 12455 - RNA, 330 nt, Artificial Sequence
  derived and/or modified sequence opt1 from anti-influenza_Chain
gacaucgugaugacccagagccccuccuuccugagcgccuccgucggcgaccgcgugaccaucacgugccggaccagccaggugaucuccagcuaccucgccugguaccagcagcgcccggggaaggcgcccaagcugcugaucuacgccgccuccacccuccagagcggcguccccucccgguucagcggguccggcagcgggacccgcuucucccugacgaucagcaaccugcagcccgaggacuucgccaccuacuucugccagcagcucaccaccuacccgcccaucacguucggccagggcacccggcuggagaucaagcgcacc

SEQ ID NO: 12456 - RNA, 330 nt, Artificial Sequence
  derived and/or modified sequence opt1 from anti-influenza_Chain
gacaucgugcugacccagagccccuccgucagcguggccccgggccagaccgcccgcaucacgugcgggggcaacgacaucggguccaagagcgugcacugguaccagcagaagcccggccaggcgcccguccucgugguguucgacgaccgggaccgccccuccgggaucccggagcgguucagcggcuccaacagcggcaacaccgccacccugaccaucucccgcgucgaggccggggacgaggccgacuacuacugccaggugugggacaucacgagcgaccugguggucuucggcgggggcaccaagcucaccgugguggggcag

SEQ ID NO: 12457 - RNA, 330 nt, Artificial Sequence
  derived and/or modified sequence opt1 from anti-influenza_Chain
gacaucgugaugacccagcccccgggcacccugagcgucucccccggggagcgcgccacgcucagcugccgggccucccagagcguguccaccaaccuggcgugguaccagcagaagcccggccaggcgccccgccugcucauccacggggccagcacccgggccaccggcaucccggcccgcuucuccgggagcggcuccggcgccgaguucacgcugaccaucagcucccugcagagcgaggacguggccgucuacuacugccagcaguacgacaacuggcuccccaucaccuucgggcccggcaccaagguggacauccagcggacg

SEQ ID NO: 12458 - RNA, 330 nt, Artificial Sequence
  derived and/or modified sequence opt1 from anti-influenza_Chain
gaccccaugcugacccagaccgccagccccguguccgccgcggucggcgggacggugaccaucaacugccaggccagccaguccguguacaacaagaacaaccucgccugguaccagcagaagcugggccagccgcccaagcugcucaucuacgccgccagcacccugaccuccgggguccccagccgcuucaagggcuccgggagcggcacgcaguucacccugaccaucuccgaccucgagugcgacgacgcggccaccuacuacugcgccggcgacuacagcgggggcaucuacgccuucgggggcgggacgaagguggagaucaag

SEQ ID NO: 12459 - RNA, 330 nt, Artificial Sequence
  derived and/or modified sequence opt1 from anti-influenza_Chain
gagcuggugaugacccagacccccgccagcgucuccgccgcggugggcgggacggugaccaucagcugccaguccagcgaguccgucuacaagaacaacaaccucgccugguuccagcagaagcugggccagccgcccaagcugcucaucuacgacgccagcaagcuggccuccggggugcccagccgcuucuccggcagcggguccggcacccaguucacccugacgaucagcgaccucgagugcgacgacgccgcgaccuacuacugcgccggcgacuacuccgggagcaacuacgccuucggcgggggcaccaagcuggagaucaag

SEQ ID NO: 12460 - RNA, 330 nt, Artificial Sequence
  derived and/or modified sequence opt1 from anti-influenza_Chain
gagcccaugcugacccagaccgccagcuccgugagcgccgcggucggcggguccgugacgaucagcugccaguccagccaguccguggacagcaacaaccagcucuccugguaccagcagaagcccggccagccgcccaagcugcugaucuacgccgccagcacccucaccuccgggguccccagccgcuucaagggcuccgggagcggcacccaguucacgcugaccaucuccgaccuggagugcgacgacgccgccaccuacuacugcgcgggcgacuacagcgggggcaucuacgccuucgggggcgggaccgaggugguggucaag

SEQ ID NO: 12461 - RNA, 330 nt, Artificial Sequence
  derived and/or modified sequence opt1 from anti-influenza_Chain
gaccccaugcugacccagaccgccgccagcguguccgcggccgucggcgggacggugaccaucagcugccaguccagcgaguccguguacaagaacaacaaccucgccugguuccagcagaagcugggccagccgcccacccugcucaucugggacgccagcaagcuggccuccgggguccccagccgcuucuccggcagcggguccggcacccaguucacgcugaccaucagcgaccucgagugcgacgacgcggccaccuacuacugcgccggcgacuacuccggggugaacuacgccuucggcgggggcaccgagguggucgugaag

SEQ ID NO: 12462 - RNA, 330 nt, Artificial Sequence
  derived and/or modified sequence opt1 from anti-influenza_Chain
gagcuggugaugacccagacccccgccagcgucuccgccgcggugggcgggacggugaccaucagcugccaguccagcgaguccgucuacaagaacaacaaccucgccugguuccagcagaagcugggccagccgcccaagcugcucaucuacgacgccagcaagcuggccuccggggugcccagccgcuucuccggcagcggguccggcacccaguucacccugacgaucagcgaccucgagugcgacgacgccgcgaccuacuacugcgccggcgacuacuccgggagcaacuacgccuucggcgggggcaccgagguggucgugaag

SEQ ID NO: 12463 - RNA, 330 nt, Artificial Sequence
  derived and/or modified sequence opt1 from anti-influenza_Chain
gaccccaugcugacccagaccgccagcuccgugagcgccacggucggcgggaccgugaccaucuccugccagagcucccagagcguggacaacaacaaggaccucgcgugguuccagcagaagccgggccacucccccaagcugcugaucuacuucgccagccgccucgccuccgggguccccagccgguucaagggcuccgggagcggcacccacuucacgcugaccaucuccgaccuggagugcgacgacgccgccaccuacuacugcgcgggcgacuacagcggggccaacuacgccuucggcgggggcaccaagcucgagaucaag

SEQ ID NO: 12464 - RNA, 330 nt, Artificial Sequence
  derived and/or modified sequence opt1 from anti-influenza_Chain
gaccccaugcugacccagaccgccagccccguguccgccgcggucggcgggacggugaccaucaacugccagagcucccagagcguguacaacaacaaccgccucuccugguuccagcagaagcccggccagccgcccaagcugcugaucuacagcgccuccacccucgccagcggggucuccagccgguucaagggcuccgggagcggcacccaguucacgcugaccaucuccgaccuggagugcgacgacgccgccaccuacuacugcgcgggcgacuacagcgggggcaucuacgccuucgggggcgggaccgagcucgagauccug

SEQ ID NO: 12465 - RNA, 330 nt, Artificial Sequence
  derived and/or modified sequence opt1 from anti-influenza_Chain
gagcuggugcucacccagacccccgccagcgucuccgccgcggugggcgggacggugagcaucuccugccagagcucccagagcgucuacaagaacaacaaccuggccugguuccagcagaagcugggccagccgcccacccuccugaucugggacgccuccaagcuggccagcggggugcccucccgcuucagcggcuccgggagcggcacccaguucacccucacgaucuccgaccuggagugcgacgacgccgcgaccuacuacugcgccggcgacuacagcggggugaacuacgccuucggcgggggcaccaagcuggagaucaag

SEQ ID NO: 12466 - RNA, 330 nt, Artificial Sequence
  derived and/or modified sequence opt1 from anti-influenza_Chain
gagcuggaccucacccagacccccgccagcguguccgccgcggucggcgggacggugaccaucagcugccaguccagcgaguccguguacaagaacaacaaccuggccugguuccagcagaagcugggccagccgcccacccuccugaucugggacgccagcaagcuggccuccgggguccccagccgcuucuccggcagcggguccggcacccaguucacgcucaccaucagcgaccuggagugcgacgacgccgcgaccuacuacugcgccggcgacuacuccggggugaacuacgccuucggcgggggcaccgagguggucgugaag

SEQ ID NO: 12467 - RNA, 330 nt, Artificial Sequence
  derived and/or modified sequence opt1 from anti-influenza_Chain
gacauccagaugacccagagccccuccagccuguccgccagcgugggcgaccgcgucaccaucacgugccaguccagcgaguccguguacaagaacaacaaccucgccugguaccagcagaagccggggaagccgcccaagcugcugaucugggacgcgagcaagcucgccuccggcgugcccagccgguucuccgggagcggcuccgggaccgacuucacccugaccaucagcucccugcagcccgaggacgucgccacguacuacugcgccggcgacuacagcggcgugaacuacgccuucgggggcgggaccgagguggucgugaag

SEQ ID NO: 12468 - RNA, 333 nt, Artificial Sequence
  derived and/or modified sequence opt1 from anti-influenza_Chain
gacaucgugaugacccagagccccgacucccuggccgucagccucggcgagcgcgccaccaucaacugcaaguccagccaguccgugacguucaacaacaagaacuaccuggcgugguaccagcagaagcccgggcagccgcccaagcugcucaucuacugggccagcacccgggaguccggcgugcccgaccgcuucagcggguccggcagcgggaccgacuucacccugacgaucuccagccugcaggccgaggacgucgccguguacuacugccagcagcacuaccggaccccgcccaccuucggccagggcaccaagguggagaucaag

SEQ ID NO: 12469 - RNA, 333 nt, Artificial Sequence
  derived and/or modified sequence opt1 from anti-influenza_Chain
cagagcgcccugacccagcccgccuccgugagcggcuccccggggcagagcaucaccaucuccugcacgggcaccgggagcgacgucggcuccagcaaccucguguccugguaccagcagcaccccgcgaaggcccccaagcugaucaucuacgaggugaccaagcgccccagcggggucuccaaccgguucagcggcuccaagagcggcaacaccgccucccugacgaucagcgggcuccaggccgaggacgaggccgacuacuacugcugcuccuacgcgggcagcuccagcagccgcguguucgggaccggcaccaaggugaccguccug

SEQ ID NO: 12470 - RNA, 333 nt, Artificial Sequence
  derived and/or modified sequence opt1 from anti-influenza_Chain
cagagcgugcugacccagcccccguccgccagcggcacccccgggcagcgcgucacgaucuccugcagcggcuccaccagcaacaucggguccaacgccgugaacugguaccagcagcuccccggcaccgcgcccaagcugcugaucuacagcaacaaccagcggccguccggggugcccgaccgcuucagcggcuccaagagcggcaccuccgccagccucgccaucuccgggcugcagagcgaggacgaggccgacuacuacugcgccgcgugggacgacucccugagcggcuccugggucuucgggggcgggacgaagcucaccgugcug

SEQ ID NO: 12471 - RNA, 333 nt, Artificial Sequence
  derived and/or modified sequence opt1 from anti-influenza_Chain
gagaccacccugacgcagagccccggcacccucucccugagcccgggggagcgcgccacccuguccugccgggugagccaguccgucagcuccaacuaccucgccugguaccagcagaagcccggccaggcgccccgccugcugaucuacggggccagcucccgggccaccggcauccccgaccgcuucagcggguccggcagcggcacggacuucacccucaccaucucccggcuggagccggaggacuucgccguguacuacugccagcaguacgggaccagcccccgcgccuucggccacgggacgaagguggagaucaagcggaccguc

SEQ ID NO: 12472 - RNA, 333 nt, Artificial Sequence
  derived and/or modified sequence opt1 from anti-influenza_Chain
cagagcgugcugacccagcccccguccgucagcggcgcccccgggcagcgcgugaccaucuccugcggcgggagccgguccaacaucggcgccggguacgacgugcacugguaccagcaguuccccggcacggcgcccaaggucgugaucuacggcaacaacaaccgcccgagcggggugcccgaccgguucuccggcagcaaguccgggaccagcgccucccucgccaucaccggccugcaggccgaggacgaggccaacuacuacugccagagcuacgacaccaaccucgggggcuccaucuucggcgggggcacgcaggucaccgugcug

SEQ ID NO: 12473 - RNA, 333 nt, Artificial Sequence
  derived and/or modified sequence opt1 from anti-influenza_Chain
aacuucaugcugacccagccccacagcguguccgagagcccgggcaagaccgucacgaucuccugcaccgggagcuccggcagcaucgccuccaacuacgugcagugguaccagcagcgccccgggagcgcccccaccaccgugaucuacgaggacuaccagcggcccuccggcgucccggaccgcuucagcggguccaucgacagcuccagcaacuccgcgagccucacgaucuccggccugaagaccgaggacgaggccgacuacuacugccagagcuacgacgacuccgaccaccugaucuucggcgggggcaccaagcucaccgugcug

SEQ ID NO: 12474 - RNA, 333 nt, Artificial Sequence
  derived and/or modified sequence opt1 from anti-influenza_Chain
cagagcaugcugacccagcccccguccgccagcggcacccccgggcagcgcgugacgaucuccugcagcggcuccagcuccaacaucgggagcaacaccgucaacugguucaagcaccuccccggcaccgcccccaagcugcugaucuaccggaacgaccuccgcccguccggggugcccgaccgguucagcggcuccaagagcggcaccuccgcgagccuggccaucuccgggcugcagagcgaggacgaggccgacuacuacugcgccacgugggacgacucccucaacggcuucuacguguucgggaccggcaccaaggucaccgugcug

SEQ ID NO: 12475 - RNA, 333 nt, Artificial Sequence
  derived and/or modified sequence opt1 from anti-influenza_Chain
gacauccagcugacccagagccccuccagccucuccgccagcgccggcgaccgcguguccaugaccugccgggcgagccagaucaucuccagcucccugaacugguaccagcagaagccggggaaggcccccaagcugcucaucuacgccgccagcaaccugcaguccggcguccccagccgcuucuccgggagcggcuccgggacggacuucacccugaccaucagcucccuccagcccgaggacuucgccaccuacuacugccagcagagcuacuccacgccgcccgagcugaccuucggcggcgggaccaagguggacaucaagcggacc

SEQ ID NO: 12476 - RNA, 333 nt, Artificial Sequence
  derived and/or modified sequence opt1 from anti-influenza_Chain
agcuacgugcugacccagcccccguccgccagcggcacccccgggcagcgcgucacgaucuccugcagcggcuccaccuucaacaucgggagcaacgccguggacugguaccggcagcuccccggcaccgcgcccaagcugcugaucuacuccaacaaccagcgcccgagcggggugcccgaccgguucuccggcagccgcuccggcaccagcgccucccucgccaucagcgggcugcaguccgaggacgaggccgacuacuacugcgccgcgugggacgacauccugaacguccccguguucggcgggggcacgaagcucaccgugcugggg

SEQ ID NO: 12477 - RNA, 333 nt, Artificial Sequence
  derived and/or modified sequence opt1 from anti-influenza_Chain
cagagcgcccugacccagcccgccgcgguguccggcagcccggggcaguccaucaccaucagcugcacgggcaccuccagcgacgucgggggcuacaacuacguguccugguaccagcagcaccccgggaaggcccccaagcucaugaucuacgaggugagcaaccgccccuccggcgucagcaaccgguucuccggcagcaaguccgggaacaccgccagccugaccaucuccggccugcaggccgaggacgaggccgacuacuacugcagcuccuacacgagcuccagcaccuacguguucgggaccggcaccaaggugacgguccucggg

SEQ ID NO: 12478 - RNA, 333 nt, Artificial Sequence
  derived and/or modified sequence opt1 from anti-influenza_Chain
agcuacgugcugacccagcccccguccgucagcggcacccccgggcagcgcgugacgaucuccugcagcggcucccggagcaacgugggggacaacuccgucuacugguaccagcacgugcccgagauggcccccaagcuccugguguacaagaacacccagcgcccgagcggcguccccgcccgguucuccgggagcaaguccggcaccagcgcgucccuggccaucaucggccuccagagcggggacgaggccgacuacuacugcguggccugggacgacuccguggacggcuacgucuucgggagcggcaccaaggugacggugcugggg

SEQ ID NO: 12479 - RNA, 333 nt, Artificial Sequence
  derived and/or modified sequence opt1 from anti-influenza_Chain
agcgugcugacccagcccccguccgucagcgccgcccccggccagaaggugaccaucuccugcagcggguccagcuccaacaucggcaacgacuacgugagcugguaccagcagcuccccgggacggcgcccaagcugcugaucuacgacaacaacaagcgcccguccggcauccccgaccgguucagcggguccaagagcggcaccuccgccacccucggcaucaccgggcugcagacgggcgacgaggccaacuacuacugcgccaccugggaccgccggcccaccgccuacgucguguucgggggcgggaccaagcugacggugcucggc

SEQ ID NO: 12480 - RNA, 333 nt, Artificial Sequence
  derived and/or modified sequence opt1 from anti-influenza_Chain
cagagcgcccugacccagccccgcuccgugagcggcuccccggggcagagcgucaccaucuccugcacgggcaccagcuccgacgucgggggcuacaacuacgugagcugguaccagcagcaccccgggaaggcccccaagcucaugaucuacgacguguccaagcggcccagcggcgugccggaccgcuucuccggcagcaaguccgggaacaccgcgagccugaccaucuccggccugcaggccgaggacgaggccgacuacuacugcagcuccuacacgagcuccagcacccacguguucgggaccggcaccaaggucacggugcucggg

SEQ ID NO: 12481 - RNA, 333 nt, Artificial Sequence
  derived and/or modified sequence opt1 from anti-influenza_Chain
agcuacgugcugacccagcccccguccgccagcggcacccccgggcagcgcgucacgaucuccugcagcggcuccagcuccaacaucgggagcaacuacguguacugguaccagcagcuccccggcaccgcccccaagcugcugaucuaccgggacgggcagcgcccguccggcgugcccgaccgguucagcggcuccaagagcgggaccuccgcgagccucgccaucuccggccugcgcagcgacgacgaggccgacuacuacugcgccaccugggacgacaaccuguccgggcccgucuucggcgggggcacgaagcucaccgugcugggc

SEQ ID NO: 12482 - RNA, 333 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucgggggcuacaacuacgugagcugguaccagcagcaccccgggaaggcgcccaagcucaugaucuacgagguguccaaccgccccagcggcgucuccaaccgguucagcggcuccaagagcgggaacaccgccucccugaccaucagcggccugcaggccgaggacgaggccgacuacuacugcuccagcuacacguccagcagcacccucguguucgggaccggcaccaaggugacgguccugggg

SEQ ID NO: 12483 - RNA, 333 nt, Artificial Sequence
  derived and/or modified sequence opt1 from anti-influenza_Chain
accgugcugacccagcccccgagcgucuccggcgcccccgggcagcgcgugacgaucagcugcaccggcuccagcuccaacaucggggccggcuacgacgugcacugguaccagcagcuccccgggaccgcgcccaagcugcugaucuacggcaacagcaaccggccguccggcguccccgaccgcuucagcggguccaagagcggcaccuccgccacgcucgggaucaccggccugcagaccggggacgaggccgacuacuacugcggcaccugggacagcucccugagcgccuacguguucggcacggggaccaaggugaccguccucggc

SEQ ID NO: 12484 - RNA, 333 nt, Artificial Sequence
  derived and/or modified sequence opt1 from anti-influenza_Chain
ggcagcgcccugacccagccccgcuccgugagcggguccccgggccagagcgucaccaucuccugcacggggaccagcuccgacgugggcggguacaacuacgugagcugguaccagcagcaccccggcaaggcccccaagcucaugaucuacgacgucuccaagcggcccagcggcgugccggaccgcuucuccgggagcaaguccggcaacaccgcgagccugaccaucuccgggcugcaggccgaggacgaggccgacuacuacugcagcuccuacacgagcuccagcacccacguguucggcaccgggaccaaggucacggugcucggc

SEQ ID NO: 12485 - RNA, 333 nt, Artificial Sequence
  derived and/or modified sequence opt1 from anti-influenza_Chain
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuucggggccuccacccgggccaccggcauccccgaccgcuucagcggguccggcagcggcaccgacuucacgcucaccaucucccggcuggagccggaggacuucgccguguucuacugccagcaguacgggagccugccccucaccuucggcgggggcaccaagguggagaucaaggggacgguc

SEQ ID NO: 12486 - RNA, 333 nt, Artificial Sequence
  derived and/or modified sequence opt1 from anti-influenza_Chain
gagaucgugcugacccagagccccggcacccucucccugagcccgggggagcgcgccacgcuguccugccgggccagccaguccguccgcagcaacaaccucgcgugguaccagcacaagcccggccaggcgccccggcugcugaucuucggggccuccagccgcgccaccggcauccccgaccgguucuccgggagcggcuccggcaccgacuucacccucacgaucagccgccuggagccggaggacuucgccguguacuacugccagcaguacggguccagccccgcccugaccuucggcgggggcaccaagguggagaucaagcggacc

SEQ ID NO: 12487 - RNA, 333 nt, Artificial Sequence
  derived and/or modified sequence opt1 from anti-influenza_Chain
cagagccuggaggaguccggcgggggccucgugaagcccgggggcagccugacccugaccugcacggucuccgggcucagccuguacuccaacgagaucaacugggugcgccaggccccgggcaacggccuggaguggaucggggccaucgcgggcagcggguccgccgacuacgccagcugggccaagggccgguccaccaucacccgcaacaccgaccucaacacggugacccugaagaugaccagccugaccgccgcggacacggccaccuacuucugcgccuccuucugggaccucugggggcccggcacccuggucaccgugagcucc

SEQ ID NO: 12488 - RNA, 333 nt, Artificial Sequence
  derived and/or modified sequence opt1 from anti-influenza_Chain
cagagcguggaggaguccggcgggggccuggucaagcccgggggcagccucacccugaccugcacgguguccgggcugagccucuacuccaacgagaucaacugggugcgccaggccccgggcaacggccuggaguggaucggggccaucgcgggcagcggguccgccgacuacgccagcugggccaagucccggagcaccaucacccgcaacaccaaccugaacacggucacccucaagaugaccucccugaccgccgcggacacggccaccuacuucugcgccagcuucugggaccuguggggccccgggacccucgugaccguguccagc

SEQ ID NO: 12489 - RNA, 333 nt, Artificial Sequence
  derived and/or modified sequence opt1 from anti-influenza_Chain
cagagccuggaggaguccggcgggggccucgugaagcccgggggcagccugacccugaccugcacggucuccgggcucagccuguacuccaacgagaucaacugggugcgccaggccccgggcaacggccuggaguggaucggggccaucgcgggcagcggguccgccgacuacgccagcugggccaagucccggagcaccaucacccgcaacaccaaccucaacacggugacccugaagaugaccucccugaccgccgcggacacggccaccuacuucugcgccagcuucugggaccucuggggccccgggacccuggucaccguguccagc

SEQ ID NO: 12490 - RNA, 333 nt, Artificial Sequence
  derived and/or modified sequence opt1 from anti-influenza_Chain
aacaucgugcugacccagagccccgccucccucgccgucagccugggccagcgcgcgaccaucuccugccgggccagcgaguccguggacaucuacgggaacagcuucaugcacugguaccagcagaagccgggccagccgcccaagcugcucaucuaccuggccuccaagcuggagugcggggugugcgcccgcuucaacggcagcgggugccggacggacuucacccucgccaucgaccccgucgagggcgacgacggcgcgaccuacuacugccagcagaacuacgaggaccccuggaccuucgggggcgggacgaagcuggagaucaag

SEQ ID NO: 12491 - RNA, 333 nt, Artificial Sequence
  derived and/or modified sequence opt1 from anti-influenza_Chain
aacaucgugcugacccagagccccgccucccucgccgucagcccgggccagcgcgcgaccaucuccugccgggccagcgaguccaucgacaucuacgggaacagcuucaugcacugguaccagaagaagcccggccagccgcccaagcugcugaucuaccgcgccuccaaccucgagagcggggugcccgcccgguucaacggcuccgggagccgcacggacuucacccugaccaucgaccccguggagggcgacgacggcgccaccuacuacugccagcagaacuacgaggaccccuggacguucgggggcgggaccaagcuggagaucaag

SEQ ID NO: 12492 - RNA, 333 nt, Artificial Sequence
  derived and/or modified sequence opt1 from anti-influenza_Chain
gagaucgugcugacccagagccccgccacccucucccuguacccgggcgagcgcgccacgcugagcugccgggcgucccagagcgucucccgcuaccucgccugguaccagcagaagcccgggcaggcgccccggcugcugaucuacgacgccagcaaccgcgccaccggcauccccgcccgguucuccgggagcggcuccgggaccgacuucacccucacgaucagcucccuggagccggaggacuucgccguguacuacugccagcagcgcagcaacuggcugaagaucaccuucggccagggcacccggcucgagaucaaggggaccgug

SEQ ID NO: 12493 - RNA, 336 nt, Artificial Sequence
  derived and/or modified sequence opt1 from anti-influenza_Chain
gacaucgugaugacccagagccccgacucccuggccgucagccucggcgagcgcgccaccaucaacugcaaguccagccaguccgugcuguacagcuccaacaacaagaacuaccuggcgugguaccagcagaagccggggcagccgcccaagcuccugaucgacugggccagcacgcgggaguccggcgugcccgaccgcuucagcggguccggcagcgggaccgacuucacccugaccaucuccaaccuccaggucgaggacguggccguguacuacugccagcaguacuaccggagccccuccuucggccagggcacgaagcuggagaucaag

SEQ ID NO: 12494 - RNA, 336 nt, Artificial Sequence
  derived and/or modified sequence opt1 from anti-influenza_Chain
gacaucgugaugacccagacgccccugagccucuccgucaccccgggccagcccgccagcaucuccugcaagagcucccagagccugcugcacuccgacgggaagaccuaccucuacugguaccugcagaagcccggccagagcccccagcugcucaucuacgagguguccaaccgcuucagcggggugccggaccgguucuccggcagcggguccggcaccgacuucacccugaagaucagccgcgucgaggccgaggacgugggcguguacuacugcaugcagaacauccugcucccccugacguucgggggcgggaccaaggucgagaucaag

SEQ ID NO: 12495 - RNA, 336 nt, Artificial Sequence
  derived and/or modified sequence opt1 from anti-influenza_Chain
gagaucgugaugacccagacgccccugagccucuccgucaccccgggccagcccgccagcaucuccugccgcagcucccagagccugcugcacuccgacgggaagaccuaccucuacugguaccugcagaagcccggccagcccccgcagcugcucaucagcgagguguucaaccgguucuccggggugcccgaccgcuucagcggcuccgggagcggcaccgacuucacccugaagaucucccgggucgaggccgaggacgugggcguguacuacugcaugcagagccugcagcucccccugacguucgggggcgggaccaaggucgagaucaag

SEQ ID NO: 12496 - RNA, 336 nt, Artificial Sequence
  derived and/or modified sequence opt1 from anti-influenza_Chain
gacaucgugaugacccagagcccccugucccucccggucacccccggcgagcccgccagcaucuccugccgcgccagccagucccugcugcacagcaacggguacaacuaccucgacugguaccugcagaagcccggccaguccccgcagcugcucauccagcuggggagcacgcgggcguccggcgugcccgaccgcuucagcggguccggcagcggcaccgacuucacccuggagaucucccggguggaggccgaggacgucgggguguacuacugcaugcaggcccuccagcugccccuggccuucggccaggggacccgccucgagaucaag

SEQ ID NO: 12497 - RNA, 336 nt, Artificial Sequence
  derived and/or modified sequence opt1 from anti-influenza_Chain
gacaucgugaugacccagagcccccugucccucccggucagccccggcgagcccgccuccaucagcugccgcuccagccagucccugcugcacgggaacggcuacaacuaccucgacugguaccugcagaagcccgggcagagcccgcggcugcucaucuaccugggcuccaaccgcgccagcggggugcccgaccgguucuccggcagcggcuccgggaccgacuucacccugaagaucagccgcguggaggcggaggacgucggcguguacuacugcaugcaggcccuccagacgccccugaccuucgggggcgggaccaagguggagaucaag

SEQ ID NO: 12498 - RNA, 336 nt, Artificial Sequence
  derived and/or modified sequence opt1 from anti-influenza_Chain
cagagcgugcugacccagcccccguccgucagcggcgcccccgggcagcgcgugaccaucuccugcacgggcagcuccagcaacaucggggccggcuacgacgugcacugguaccagcagcuccccgggaccgcgcccaagcugcugaucuacgacaacaacaaccggccguccggcguccccgaccgcuucagcggcuccaagagcggggccuccgccagccucgccaucaccggccugcaggccgaggacgaggcgcacuacuacugccaguccuacgacaacagccuguccgggagcguguucggcgggggcacccagcucacggugcugucc

SEQ ID NO: 12499 - RNA, 336 nt, Artificial Sequence
  derived and/or modified sequence opt1 from anti-influenza_Chain
cagagcgugcugacccagcccccguccgucagcggcgcccccgggcagcgcgugaccaucuccugcacgggcagcuccagcaacaucggguccgacuacgacgugcacugguacaagcagcuccccggcaccgcccccaagcugcugaucuucgggaacagcaaccggccguccggcguccccgaccgcuucagcggcuccaagagcgggaccuccgcgagccucgccaucaccggccugcaggccgaggacgaggccgacuacuacugccaguccuacgacagcucccugagcggguuccacguguucggcuccgggacgaaggugaccguccuc

SEQ ID NO: 12500 - RNA, 336 nt, Artificial Sequence
  derived and/or modified sequence opt1 from anti-influenza_Chain
cagagcgugcugacccagcccccguccgucagcgccgcccccggccagaaggugaccaucuccugcagcggguccagcuccaacaucggcaacgacuacgugagcugguaccagcagcuccccgggacggcgcccaagcugcugaucuacgacaacaacaagcgcccguccggcauccccgaccgguucagcggguccaagagcggcaccuccgccacccucggcaucaccgggcugcagacgggcgacgaggccaacuacuacugcgccaccugggaccgccggcccaccgccuacgucguguucgggggcgggaccaagcugacggugcucggc

SEQ ID NO: 12501 - RNA, 336 nt, Artificial Sequence
  derived and/or modified sequence opt1 from anti-influenza_Chain
gagaucgugcugacccagagccccggcacccucucccugagcccgggggagcgcgccacgcuguccugccgggccagccaguccgucagcuccagcuaccucgccugguaccagcagaagcccggccaggcgccccgccugcugaucuacggggccuccacccgggccaccggcauccccgaccgcuucagcgggcggggcuccggcaccgacuucacgcucaccaucagcucccuggagccggaggacuucgccguguacuacugccagaacuacgggagccccuuccuguucaccuucggccccgggaccaagguggacaucaagcgcacgguc

SEQ ID NO: 12502 - RNA, 336 nt, Artificial Sequence
  derived and/or modified sequence opt1 from anti-influenza_Chain
gacauccagcugacccagagcccccucuccccgcccgugacccugggccagcccgccagcaucuccugccgcagcucccagagccugcucuacacggacggguucaccuaccuguccugguaccaccagcggcccggccagagcccgcgccggcugaucuacaagaucuccaaccgcgacagcgggguccccgaccgguucuccggcagcggguccggcaccgacuucacccucaagaucagccgcguggaggccgaggacgugggcgucuacuacugcaugcaggcgacgcacuggccccugaccuucggggagggcaccaagguggagaucaag

SEQ ID NO: 12503 - RNA, 336 nt, Artificial Sequence
  derived and/or modified sequence opt1 from anti-influenza_Chain
gacaucgagcugacccaggagcccagcgccuccggcaccccggggcagcgcgugacgaucagcugcuccggcgacaccagcaacaucggguccaacaccgucagcugguuccagcuccugcccggcaccgcccccaagcugcucaucuucacggacaaccagcggcccuccggggugccgggccgcuucagcggcuccaagagcgggaccuccgcgagccuggccaucuccggccugcagagcgaggacgagaccgacuacuacugcgccgccugggacgacucccucaacggguggguguucggcgggggcaccaagcugacgguccugggccag

SEQ ID NO: 12504 - RNA, 336 nt, Artificial Sequence
  derived and/or modified sequence opt1 from anti-influenza_Chain
gacaucgugcugacccagagccccuccgccagcggcuccccggggcagagcgucaccaucuccugcacgggcaccagcuccgacgucgggggcuacgacuacgugagcugguaccagcagcaccccgggaaggcccccaagcucaugaucuacgaggugcgcaagcggcccuccggcgugccggaccgcuucagcggcuccaagagcgggaacaccgcgucccugaccgugagcggccugcaggccgaggacgaggccuacuacuacugcgccuccuacgccgggacguacauccaccucuucggcgggggcaccaagcugaccguccugggccag

SEQ ID NO: 12505 - RNA, 336 nt, Artificial Sequence
  derived and/or modified sequence opt1 from anti-influenza_Chain
caggagcagcugauggagagcggcgggggccucgugaagcccgggggcucccugacccugaccugcacggucagcgggcucucccuguacagcaacgagaucaacugggugcgccaggccccgggcaacggccuggaguggaucggggccaucgcgggcuccgggagcgccgacuacgccuccugggccaagagccgguccaccaucacccgcaacaccaaccucaacacggugacccugaagaugaccagccugaccgccgcggacacggccaccuacuucugcgccuccuucugggaccucuggggccccgggacccuggucaccgugagcucc

SEQ ID NO: 12506 - RNA, 336 nt, Artificial Sequence
  derived and/or modified sequence opt1 from anti-influenza_Chain
cagcagcagcugauggagagcggcgggggccucgugaagcccgggggcucccugacccugaccugcacggucagcgggcucucccuguacagcaacgagaucaacugggugcgccaggccccgggcaacggccuggaguggaucggggccaucgcgggcuccgggagcgccgacuacgccuccugggccaagagccgguccaccaucacccgcaacaccgaccucaacacggugacccugaagaugaccagccugaccgccgcggacacggccaccuacuucugcgccuccuucugggaccucuggggccccgggacccuggucaccgugagcucc

SEQ ID NO: 12507 - RNA, 336 nt, Artificial Sequence
  derived and/or modified sequence opt1 from anti-influenza_Chain
cagcagcagcugguggagagcggcgggggccucgucaagcccgggggcucccugacccugaccugccgcgugagcgggcucucccuguucagcaacgagaucaacugggugcggcaggccccgggcaacggccuggaguggaucggggccaucggcgggggcggguccgcggacuacgccagcugggccaagucccgcagcacgaucacccggaacaccaaccucaacaccgucacgcugcgcaugaccucccugaccgccgccgacaccgcggccuacuucugcgccagcuucugggaccucuggggccccggcacgcuggugaccguguccagc

SEQ ID NO: 12508 - RNA, 336 nt, Artificial Sequence
  derived and/or modified sequence opt1 from anti-influenza_Chain
gaggugcagcuggucgagagcggcgggggccucgugaagcccgggggcucccugcgccugagcugcgccgccuccgggcucagccuguucuccaacgagaucaacugggugcggcaggcgccgggcaagggccuggaguggaucggggccaucggcgggggcgggagcgccgacuacgccuccugggccaagagccgcuucaccaucucccgggacaacgcgaagaacagccucuaccugcagaugaacucccugcgcgccgaggacaccgccgucuacuucugcgccagcuucugggaccucuggggccccggcacgcuggugaccguguccagc

SEQ ID NO: 12509 - RNA, 336 nt, Artificial Sequence
  derived and/or modified sequence opt1 from anti-influenza_Chain
gacaucgugaugacccagagcccccugucccucccggucacccccggcgagcccgccagcaucuccugccgcagcucccagagccugcugcgguccaacggguacaacuaccucgacugguaccugcagaagcccggccagagcccgcagcugcucaucuaccugggguccaaccgcgccagcggcgugcccgaccgguucuccgggagcggcuccggcacggacuucacccugaagaucagccgcguggaggcggaggacgucgggguguacuacugcaugcaggcccuccagacccccuacaccuucggccaggggacgaagcuggagaucaag

SEQ ID NO: 12510 - RNA, 339 nt, Artificial Sequence
  derived and/or modified sequence opt1 from anti-influenza_Chain
gacaucgugaugacccagagccccgacuuccugccggucucccucggcgagcgcgccaccaucaacugcaagagcucccagcgggugcuguacagcuccaacaacaagaacuaccuggccugguaccagcucaagcccgggcagccgcccaagcugaucaucuacugggcgagcacgcgcgaguccggcgugcccgaccgguucagcggguccggcagcgggaccgaguucacccugaccaucuccagccuccaggccgaggacgucgccguguacuacugccagcaguacuacucccgccccuacacguucggccagggcaccaagcuggagaucaag

SEQ ID NO: 12511 - RNA, 339 nt, Artificial Sequence
  derived and/or modified sequence opt1 from anti-influenza_Chain
gacaucgugaugacccagagccccgacucccuggccgucagccucggcgagcgcgccaccaucaacugcaaguccagccaguccgugcuguacagcuccaacaacaagaacuaccuggcgugguaccagcagaagccggggcagccgcccaagcuccugaucuacugggccagcacgcgggaguccggcgugcccgaccgcaucagcggguccggcagcggggccgacuucacccugaccaucuccagccuccaggccgaggacgucgccguguacuacugccagcaguacuucgcgacgccccggaccuucggccagggcaccaagguggagaucaag

SEQ ID NO: 12512 - RNA, 339 nt, Artificial Sequence
  derived and/or modified sequence opt1 from anti-influenza_Chain
gacaucgugaugacccagagccccgacucccuggccgucagccucggcgagcgcgccaccaucaacugcaaguccagccaguccgugcuguacagcuccaacaacaagagccaccuggcgugguaccagcagaagccggggcagccgcccaagcuccugaucuacugggccuccacgcgggagagcggcgugcccgaccgcuucuccgggagcggcuccgggaccgacuucacccugaucaucagcucccuccaggccgaggacgucgccguguacuacugccagcaguacuacuucagcccccugaccuucggcggcgggacgaagguggagaucaag

SEQ ID NO: 12513 - RNA, 339 nt, Artificial Sequence
  derived and/or modified sequence opt1 from anti-influenza_Chain
gacaucgugaugacccagagccccgacucccuggccgucagccucggcgagcgcgccaccaucaacugccgguccagccaguccaucuuccacaacagcaacaacgagaacuaccuggccugguaccagcagaagccggggcagccgcccaagcugcucaucuacugggccuccacgcgcgagagcggcgugcccgaccgguucuccgggagcggcuccgggaccgacuucacccugaccaucagcucccugcaggccgaggacguggccgucuacuucugccagcaguacuacaacgcgccccucacguucggcggcgggaccaagguggagaucaag

SEQ ID NO: 12514 - RNA, 339 nt, Artificial Sequence
  derived and/or modified sequence opt1 from anti-influenza_Chain
gagaucgugcugacccagagcccccucucccugccggucacccccggcgagcccgccagcaucuccugccgcagcucccagagccugcuccacuccaacggguacaacuaccuggacugguaccugcagaagcccggccagagcccgcagcuccugaucuaccugggguccaaccgggccagcggcgugcccgaccgcuucuccgggagcggcuccggcacggacuucacccucaagaucagccggguggaggcggaggacgucgggguguacuacugcaugcaggcccugcagacgccccugaccuucggcgggggcaccaagguggagaucaagcgc

SEQ ID NO: 12515 - RNA, 339 nt, Artificial Sequence
  derived and/or modified sequence opt1 from anti-influenza_Chain
gacaucgugcugacccagcccccgagcgucuccguggcccccggccagaccgccacgaucacgugcgggggcaacuacaucgggagcaaguccgugaacugguaccagcagcgccccggccacgcgcccguccucgugguguacgacgacagcgaccggccguccgggauccccgaccgcuucagcggcuccaacagccgguccaccgccaccaccgccacccugaccaucagccgcgucgaggccggcgacgaggccgacuacuacugccaggugugggagaccuccgaggaccuguggguguucgggggcgggacgaagcucaccguccugggccag

SEQ ID NO: 12516 - RNA, 342 nt, Artificial Sequence
  derived and/or modified sequence opt1 from anti-influenza_Chain
gacguggucaugacccagagccccgacucccuggccgugagccucggcgagcgcgccaccaucaacugcaaguccagccaguccgugcuguacagcuccaacaacaagaacuaccuggcgugguaccagcagaagccggggcagccgcccaagcuccugaucuacugggccagcacgcgggaguccggcguccccgaccgcuucagcggguccggcagcgggaccgacuucacccugaccaucuccagccuccaggccgaggacguggccguguacuacugccagcaguacuacuccacgccccugaccuucggcggcgggaccaaggucgacaucaagcgg

SEQ ID NO: 12517 - RNA, 342 nt, Artificial Sequence
  derived and/or modified sequence opt1 from anti-influenza_Chain
gacauccagaugacccagagccccgacucccuggccgugagccucggcgagaaggccaccaucaacugcaaguccagccaguccauccugaacagcuccaacaacaagaacuaccuggcgugguaccagcagaagcccgggcagccgcccaagcuccugaucuacugggccagcacgcgcgaguccggcguccccgaccgguucagcggguccggcagcgggaccgacuucacccugaccaucuccagccuccaggccgaggacguggccguguacuacugccagcaguacuacuccagcccgcccacguucggccagggcaccaaggucgagaucaagcgc

SEQ ID NO: 12518 - RNA, 342 nt, Artificial Sequence
  derived and/or modified sequence opt1 from anti-influenza_Chain
gagaucgugcugacccagagccccgccacccucucccuguacccgggcgagcgcgccacgcugagcugccgggcgucccagagcgucucccgcuaccucgccugguaccagcagaagcccgggcaggcgccccggcugcugaucuacgacgccagcaaccgcgccaccggcauccccgcccgguucuccgggagcggcuccgggaccgacuucacccucacgaucagcucccuggagccggaggacuucgccguguacuacugcugcgaccgccagcagcggagcaacuggcugaagaucaccuucggccagggcacccgccucgagaucaaggggaccgug

SEQ ID NO: 12519 - RNA, 342 nt, Artificial Sequence
  derived and/or modified sequence opt1 from anti-influenza_Chain
gacaucgugaugacccagagccagaaguucgucuccaccagcgugggcgaccgcguguccgucacgugcaaggccagccagaacgugggguccaacguggccugguaccagcacaagcccggccacagcccgaccgcgcugaucuacuccgccagccaccgguacuccgggguccccgaccgcuucaccggcagcgaguccgggaccgacuucacgcucaccaucagcaacgugcaguccgaggaccuggccgaguacuucugccagcaguacuacagcuaccccuacaccuucggcggcgggaccaagcuggagaucaagcgggccgacgccgcgcccacg

SEQ ID NO: 12520 - RNA, 342 nt, Artificial Sequence
  derived and/or modified sequence opt1 from anti-influenza_Chain
gacaucgagaugacccagagcccccugucccucccggugacccccggcgagagcgccuccaucagcugccgcuccagccagucccugcugcacagcaacggguacaacuaccucgacugguaccugcagaagcccggccagagcccccagcugcucaucuaccugggguccucccgggccagcggcgucccggaccgcuucuccgggagcggcuccggcacggacuucacccugaagaucagccggguggaggcggaggacgugggggucuacuacugcaugcagggccuccagacccccuacaccuucgggcagggcacgaagcuggagaucaagcgcacc

SEQ ID NO: 12521 - RNA, 342 nt, Artificial Sequence
  derived and/or modified sequence opt1 from anti-influenza_Chain
gacaucgagaugacccagagcccccugucccucccggugacccccggcgagcccgccagcaucuccugccgcagcucccagagccugcugcacuccaacggguacaaccaccucgccugguaccugcagaagcccggccggagcccgcaccuccugaucuaccuggcguccacgcgcgccagcgggguccccgaccgguucuccggcagcggguccggcaccgacuucacccugaagaucagccgcguggaggccgaggacgugggcaucuacuacugcaugcagucccuccagaccagcaucacguucgggcagggcacccggcuggagaucaagcgcacc

SEQ ID NO: 12522 - RNA, 345 nt, Artificial Sequence
  derived and/or modified sequence opt1 from anti-influenza_Chain
caggugcagcugguccagagcggcgccgaggugaagaagcccggguccagcgugcgcgucuccugcaagaccagcggcgggaccuucuccagcuacgccgugacgugggugcggcaggcgccgggccaggggcucgaguggaugggcggcaucaucgggauguucggcaccaccaacuacgcccagaaguuccaggggcgccugaccaucacggccgacgagaugaccuccaccgccuacauggagcugagcucccuccggagcgaggacaccgccgucuacuacugcgcgcgcggcuccuacuacuacgagacgacccuggacuacugggggcggggcacccug

SEQ ID NO: 12523 - RNA, 345 nt, Artificial Sequence
  derived and/or modified sequence opt1 from anti-influenza_Chain
gaggugcagcugguccagagcggcgccgaggugaagaagcccggguccagcgugaaggucuccugcaagaccagcggcgggaccuucuccagcuacgccgugacgugggugcgccaggcgccgggccaggggcucgaguggaugggcgccaucaucggcauguucgggaccaccaacuacgcccagaaguuccagggccgggucaccaucacggccgacgagcugaccuccaccgccuacauggagcugagcucccuccgcagcgacgacaccgcgguguacuacugcgcccggggguccuacuacuacgagagcucccuggacuacuggggcaaggggacgcug

SEQ ID NO: 12524 - RNA, 345 nt, Artificial Sequence
  derived and/or modified sequence opt1 from anti-influenza_Chain
caggugcagcugguccagagcggcgccgaggugaagaagcccggguccagcgugaaggucuccugcaagaccagcggcgggaccuucuccagcuacgccgugacgugggugcgccaggcgccgggccaggggcucgaguggaugggcggcaucaucgggauguucggcaccaccaacuacgcccagaaguuccaggggcgggucaccaucacggccgacgagcugaccuccaccgccuacauggagcugagcucccuccgcagcgaggacaccgccguguacuacugcgcgcggggcuccuacuacuacgagagcucccuggacuacugggggcgcggcacgcug

SEQ ID NO: 12525 - RNA, 345 nt, Artificial Sequence
  derived and/or modified sequence opt1 from anti-influenza_Chain
gaggugcagcugguccagagcggcgccgaggugaagaagcccggggccuccgugaaggucagcugcaaggcguccggcuacaccuucaccggguacuacguguacugggugcgccaggccccgggccaggggcucgaguggaugggcuggaucagcgccuacaacggcaacacgaacuacgcccagaaguuccaggggcgggucaccaucaccgccgacaaguccaccagcacggcguacauggagcuguccagccugcgcuccgaggacaccgccguguacuacugcgcccggagccgcucccucgacguguggggccaggggaccaccgucacggugagcucc

SEQ ID NO: 12526 - RNA, 345 nt, Artificial Sequence
  derived and/or modified sequence opt1 from anti-influenza_Chain
gacaucgugaugacccagagcccccugucccucccggucacccccggcgagcccgccagcaucuccugccgcagcucccagagccugcugcacuccaacgggcacaucuacuucgacugguaccuccagaagcccggccagagcccgcagcugcugaucuaccucguguccaagcgggccagcggggugcccgaccgcuucuccggcagcggguccggcacggacuucacccugaagaucagccgggucgaggcggaggacgugggcguguacuacugcaugcaggcccuggagacccccuucaccuucgggcccggcacgaagguccacaucaagcgcaccgug

SEQ ID NO: 12527 - RNA, 345 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucggggcguacaacuacgugagcugguaccagcaccaccccggcaaggcccccaagcucaugaucuacgacgugaccuaccgccccuccggggucagcacccgguucuccggcagcaaguccggcaacacggccagccugaccaucuccgggcugcaggccgaggacgaggccgacuacuacugcagcucccagagccgcuccagcacccucgugaucuucggcgggggcaccaagcugacggugcuggggcagccgaag

SEQ ID NO: 12528 - RNA, 345 nt, Artificial Sequence
  derived and/or modified sequence opt1 from anti-influenza_Chain
gacaucgugcugacccagagccccgucucccucgccgugagccugggcgaguccgccaccgugaacugcaagagcucccagagcguccuguccaacagcaagaaccucaacuaccuggcgugguaccagcacaagccggggcagccgcccaagcugcucaucuacugggccuccacgcgcgagagcggcgugcccgaccgguucuccgggagcggcuccgggaccgacuucacccugaccaucagcucccugcaggccgaggacguggccgucuacuacugccagcagcacuacagcaucccccucacguucggccccggcaccaagguggacaucaagcgcacc

SEQ ID NO: 12529 - RNA, 348 nt, Artificial Sequence
  derived and/or modified sequence opt1 from anti-influenza_Chain
gacaucgugcugacccagagcccccucucccugccggucacccccggcgagcccgccagcaucuccugccgcagcucccagagccugcucgacuccaacggguacaacuaccuggacugguaccugcagaagcccggccagagcccgcagcuccugaucuaccuggccuccuaccgggcgcccggggugcccgaccgcuucagcggcuccgggagcggcacggacuucacccucaagaucucccggguggaggccgaggacgucggccuguacuacugcaugcaggcccugcagacgcccccgauguacaccuucgggcagggcaccaagcucgagaucaagcgcacc

SEQ ID NO: 12530 - RNA, 351 nt, Artificial Sequence
  derived and/or modified sequence opt1 from anti-influenza_Chain
cuggagagcggcgggggccucgugcagcccgggggcucccugcgccugagcugcgccgccuccgggaucaccuucagcuccuacgcgaugagcuggguccggcaggccccgggcaagggccucgaguggguguccaccgugaacagcgggggcggguccacguacuacggcgacagcguccgcgggcgguucaccaucucccgcgacaacagcaaguccacccuguaccugcagcucaacagccugcgggccgaggacaccgccaucuacuacugcgccaaggacaagggccgccccaucuucggccuggugacgcccuccuacuacauggacgugugggggaacggcacc

SEQ ID NO: 12531 - RNA, 351 nt, Artificial Sequence
  derived and/or modified sequence opt1 from anti-influenza_Chain
caggagcagcuggugcagagcggcgccgaggucaagaagcccggggccuccgugaaggugagcugcaaggcgucccgcaagagcuucaucggcuacuacguccacugggugcggcaggccccggggcagggccucgaguggaugggguggaucucccccgacagcgacgccaccaaguacgcccagaaguuccagggcuccgugaucaugacccgcgacacgagcgucuccaccguguacauggagcugagccggcugaccuccgacgacaccgcccucuacuacugccugcuguuccgcggcgggaacagccucuccuggggccaggggacgcuggugaccgucagcucc

SEQ ID NO: 12532 - RNA, 351 nt, Artificial Sequence
  derived and/or modified sequence opt1 from anti-influenza_Chain
caggugcagcugcaggagagcggccccgggcucgucaagccguccgagacccugagccugaccugcacgguguccggcagcuccaucagcaacuacuacugguccuggauccgccagagccccgggaagggccucgaguggaucggguucaucuacuacggcggcaacaccaaguacaaccccucccucaagagccgggugaccaucucccaggacaccagcaagucccaggucagccugacgauguccagcgugaccgccgccgaguccgcgguguacuucugcgcccgcgccagcugcuccgggggcuacugcauccuggacuacugggggcagggcacccuggucacc

SEQ ID NO: 12533 - RNA, 351 nt, Artificial Sequence
  derived and/or modified sequence opt1 from anti-influenza_Chain
gaggugcagcuggucgagagcggcgggggccucgugcagcccgggggcucccugcgccugagcugcgccgccuccggguucaccuucagcaucuacgcgauguccugggugcggcaggccccgggcaagggccucgagugggucagcgccaucuccagcuccggggacagcaccuacuacgccgacuccgugaagggccgcuucacgaucagccgggacaacgcccgcaacacccuguaccugcagaugaacucccuccgggcggaggacaccgccguguacuacugcgcccgcgccuacggguacaccuucgaccccuggggccaggggacgcuggucaccgugagcucc

SEQ ID NO: 12534 - RNA, 354 nt, Artificial Sequence
  derived and/or modified sequence opt1 from anti-influenza_Chain
caggugcagcugcaggagagcggccccgggcucgucaagccguccgagacccugagccugaccugcacgguguccggcuacagcuucgacuccggguacuacuggggcuggcuccgccagccgcccgggaagggccuggaguggaucggcagcaucuaccacucccggaacaccuacuacaaccccagccugaagucccgcgugaccaucagcgucgacaccuccaagaaccaguucagccuccagcuguccagcgugacggccgccgacaccgcgguguacuacugcgcccgggggaccugguacuccagcaaccugcgcuacugguucgaccccuggggcaaggggacccuc

SEQ ID NO: 12535 - RNA, 354 nt, Artificial Sequence
  derived and/or modified sequence opt1 from anti-influenza_Chain
cagcccgugcugacccagccgcccagcgccuccgccagccucggcgcguccgucacccugacgugcacccugagcuccgccuacagcaacuacaagguggacugguaccagcagcgccccgggaagggcccccgguucgugaugcgcgucgggaccggcgggaucgugggcuccaagggcgacgggaucccggaccgguucagcgugcucggcuccgggcugaaccgcuaccugaccaucaagaacauccaggaggaggacgagagcgacuaccacugcggcgccgaccacggguccggcagcaacuucgucucccccuacguguucggcgggggcacgaagcucaccgugcug

SEQ ID NO: 12536 - RNA, 354 nt, Artificial Sequence
  derived and/or modified sequence opt1 from anti-influenza_Chain
caggugcagcugguccagagcggcgccgacgugaagaagcccggguccagcgugaccgucuccugcaaggccagcggcggguccuucagcaacuacggcaucaacugggugcgccaggcgccggggcagggccucgaguggaugggcgggaucaucccccugaucaacgcccccaacuacgcccccaaguuccagggccgggugaccaucacggccgacauguucuccaacaucgucagccugcagcucaccucccugcgcaccgacgacaccgccguguacuacugcgcgcggcgcaagaugacgaccgccaucgacuacugggggcagggcacccuggugaccgucagcucc

SEQ ID NO: 12537 - RNA, 354 nt, Artificial Sequence
  derived and/or modified sequence opt1 from anti-influenza_Chain
caggugcagcugguccagagcggcgccgaggugaagaagcccggguccagcgugaaggucuccugccgcgagagcggcgggaccuucaacggcuacaccaucacgugggugcggcaggccccggggcagggccucgaguggaugggcgggaucauccccaugaugggcaccgugaacuacgcgcagaagcugcaggggcgcgucaccaucaccacggacuacuucaccaagaccgccuacauggaccugaacaaccuccgguccgaggacaccgccauguacuacugcgugaagauccgcuacacgggccagcagcugcugugggggcagggcacccucgugaccgucagcucc

SEQ ID NO: 12538 - RNA, 354 nt, Artificial Sequence
  derived and/or modified sequence opt1 from anti-influenza_Chain
caggugcagcugguccagagcggcgccgaggugaagaagcccggggccuccgugaaggucagcugcaaggcguccggccacaccuucaccggguacuacauccacugggugcgccaggccccgggccaggggcucgaguggaugggcuggaucaaccccgacagcggcgccacguccagcgcccagaacuuccaggggcgggugaccaugaccggcgacaccuccagcuccacggccuacauggagcugagccgccuguccuucgacgacaccgcggucuacuacugcgcccggguccucuucaccagccccuucgacuucuggggcgaggggacccuggugacgguguccagc

SEQ ID NO: 12539 - RNA, 354 nt, Artificial Sequence
  derived and/or modified sequence opt1 from anti-influenza_Chain
cagcccgugcugagccagccgcccuccgccagcgccucccucggcgcgagcgucacccugaccugcacgcuguccagcggguucgacaacuaccagguggccugguaccagcagcgccccggcaaggggccccgguucgugaugcgcgucggcaacgggggcaacguggccuccaagggcgacgggaucccggaccgguucagcguguccggcagcgggcucaaccgcuaccugaccaucaagaacauccaggaggacgacgaguccgacuacuacugcggcgccgaccacgggagcggcaacaacuucgucucccccuacguguucggcgggggcaccaagcugaccgugcuc

SEQ ID NO: 12540 - RNA, 354 nt, Artificial Sequence
  derived and/or modified sequence opt1 from anti-influenza_Chain
gaggugcagcuggucgagagcggcgccgaggugaagaagcccggggccuccgugaaggucagcugcaaggcguccggcuacaccuucagccgcuacuacauccacugggugcggcaggccccggggcaggagcucgaguggaugggcuggaucaaccccgacuccggggacaccaacuacgcccagaaguuccgcggccgggugacgauggcccgcgacaccagcaucuccaccgucuacauggagcugaacagccugcgguacgacgacaccgccguguacuucugcgcgcgcaucaucugguccagcuccggcauggacgugugggggcagggcacgaccgucaccgugagc

SEQ ID NO: 12541 - RNA, 354 nt, Artificial Sequence
  derived and/or modified sequence opt1 from anti-influenza_Chain
gaggugcagcugcucgagagcggcgggggcgucgugcagcccgggcgcucccugcggcugagcugcgccgccuccggcuucaccuuccgcaccuacgggaugcacugggugcggcaggcgccgggcaagggccucgagugggucgccgugaucagccacgacgggaaccugaaguacuacggcggguccgugaagggccgcuucacgaucagccgggacaacuccaagaacgcccuguaccuccagaugaacagccugcgcgucgacgacaccgcccuguacuacugcgcccgggggaucggcaucaccgacgcguucgacauccgcggccaggggaccauggugguggucucc

SEQ ID NO: 12542 - RNA, 354 nt, Artificial Sequence
  derived and/or modified sequence opt1 from anti-influenza_Chain
gaggugcagcuggucgagagcggcgggggccucgugcagcccgggggcucccugcgccugagcugcaccgccuccgggcucagcguguccagcaccuacaugaacuggguccggcaggccccgggcaagggccuggaguggguguccguguucuacagcgagacgcgcaccuacuacgcggacuccgucaaggggcgguucaccgugagccgccacaacuccaacaacacccuguaccuccagaugaacagccugcggguggaggacacggccgucuacuacugcgcccgcgugcagcggcuguccuacggcauggacgugugggggcagggcaccaccgucaccgugagcucc

SEQ ID NO: 12543 - RNA, 354 nt, Artificial Sequence
  derived and/or modified sequence opt1 from anti-influenza_Chain
gaggugcagcuggucgagagcggcgggggccucgugcagcccgggggcucccugcgccugagcugcaccgccuccgggcucagcguguccagcaccuacaugaacuggguccggcaggccccgggcaagggccuggaguggguguccguguucuacagcgagacgcgcaccuacuacgcggacuccgucaaggggcgguucaccgugagccgccacaacuccaacaacacccuguaccuccagaugaacagccugcgggccgaggacacggccguguacuacugcgcccgcguccagcggcuguccuacggcauggacgugugggggcagggcaccaccgugaccgucagcucc

SEQ ID NO: 12544 - RNA, 354 nt, Artificial Sequence
  derived and/or modified sequence opt1 from anti-influenza_Chain
gacaugcagcugguggagagcggcgggggccucgucccgcccgggggcucccugcgccugagcugcgccgccuccggguucagcguguccgacaacuacaucaacugggugcggcaggcgcccggcaagggccucgacugggucagcguguucuacuccgccgaccgcaccagcuacgccgacuccgugaaggggcgguucaccgucagcucccacgacagcaagaacacgguguaccugcagaugaacucccugcgcgccgaggacaccgccguguacuacugcgcgcggguccagaaguccuacuacggcauggacgugugggggcagggcaccaccgugacggucagcagc

SEQ ID NO: 12545 - RNA, 357 nt, Artificial Sequence
  derived and/or modified sequence opt1 from anti-influenza_Chain
gaggugcagcuggucgagagcggccccgugcucgugaagccgaccgagacccugacggugaccugcaccgucuccggguucagcguggacaacgaccgcaugggcgucuccuggauccggcagccgcccgggaaggcccuggaguggcucgcccacaucuucagcaacgacgagaaguccuacagcaccucccugcgcagccggcugacgaucuccaaggacaccagcaagcgccagguggugcucuccaugaccgacauggaccccgucgacaccgcgacguacuacugcgcccgggcccccagcgaguacgccgccauggacguguggggccaggggaccauggugaccgucucc

SEQ ID NO: 12546 - RNA, 357 nt, Artificial Sequence
  derived and/or modified sequence opt1 from anti-influenza_Chain
caggugcaggucgugcagagcggcaccgaggugaagaagcccggguccagcgucaagguguccugccagaccagcggcgggcgcuucauguccuacgccaucacgugggugcggcaggccccgggccaggggcuggaguggaugggcggcaucguccccguguucgggaccgcgaacuacgcccagaaguuccagggccgcgugaccaucaccacggacgacagcacccggaccgccuacauggagcucuccagccugcgcuccgaggacaccgccgucuacuacugcggguuccgguacggcagcggguacggcuucgacuccuggggccaggggacgcuggugaccgugagcucc

SEQ ID NO: 12547 - RNA, 357 nt, Artificial Sequence
  derived and/or modified sequence opt1 from anti-influenza_Chain
gaggugcagcuggucgagagcggcgccggggugaagaagcccggcuccagcgugaaggucuccugcaaggccagcgggaacaccuucuccagcaacgcgaucuccugggugcgccaggccccgggccaggggcucgaguggaugggcggcauccuggggaugcugcggaccacgaacuacgcccagaaguuccagggccgcgugaccaucaccgccgacgaguucaugaacaccgccuacauggagcucagcucccugacgagcgaggacaccgcggucuacuacugcgcccgguccagcggguacuaccccgacuacuuccaccuguggggccaggggacccucgugaccgugucc

SEQ ID NO: 12548 - RNA, 357 nt, Artificial Sequence
  derived and/or modified sequence opt1 from anti-influenza_Chain
caggugcagcugcaggagagcggccccgggcucgucaagccguccgagacccugagccugaccugcacgguguccggcagcuccaucagcaacuacuacugguccuggauccgccagagccccgggaagggccucgaguggaucggguucaucuacuacggcggcaacaccaaguacaaccccucccucaagagccgggugaccaucucccaggacaccagcaagucccaggucagccugacgauguccagcgugaccgccgccgaguccgcgguguacuucugcgcccgcgccagcugcuccgggggcuacugcauccuggacuacugggggcagggcacccuggucaccgugagc

SEQ ID NO: 12549 - RNA, 357 nt, Artificial Sequence
  derived and/or modified sequence opt1 from anti-influenza_Chain
gaggugcagcuggucgagagcggcgggggccucgugcagcccgggggcucccugcgcaucagcugcgccgccuccggguucaccgugagcuccaacuacaugagcuggguccggcaggcgccgggcaagggccuggaguggguguccgugaucuacagcgggggcuccaccuacuacgccgacagcgucaaggggcgcuucuccuucagccgggacaacuccaagaacacgguguuccuccagaugaacagccugcgcgccgaggacaccgccguguacuacugcgcccggugccugucccgcaugcggggcuacgggcucgacgucuggggccagggcaccaccgugacggugagc

SEQ ID NO: 12550 - RNA, 357 nt, Artificial Sequence
  derived and/or modified sequence opt1 from anti-influenza_Chain
caggugcagcugcaggagagcggccccgggcucgucaagcccuccgagacccugagccugaccugcacgguguccggcgccagcaucuccagcgacuacugguccuggauccgccucccgcccgggaagggccuggaguggaucggguacaucuacaaccggggcagcaccaaguacacccccucccucaagagccgcgugaccaucucccuggacacggccgagaaccaguucagccugcggcugcgcuccgucaccgcggccgacaccgccaucuacuacugcgcccggcacgugggcgggcacaccuacggcaucgacuacugggggcagggcacgcucgugaccgucagcucc

SEQ ID NO: 12551 - RNA, 357 nt, Artificial Sequence
  derived and/or modified sequence opt1 from anti-influenza_Chain
caggugcagcugcaggagagcggccccgggcucgucaagcccuccgagacccugagccugaccugcacgguguccggcgccagcaucuccagcgacuacugguccuggauccgccucccgcccgggaagggccuggaguggaucggguacaucuacaaccggggcagcaccaaguacacccccucccucaagagccgcgugaccaucucccuggacacggccgagaaccaguucagccugcggcugcgcuccgucaccgcggccgacaccgccguguacuacugcgcccggcacgugggcgggcacaccuacggcaucgacuacugggggcagggcacgcucgucaccgugagcucc

SEQ ID NO: 12552 - RNA, 357 nt, Artificial Sequence
  derived and/or modified sequence opt1 from anti-influenza_Chain
caggugcagcugcaggagagcggcccccgccucgucaagcccuccgagagccugucccugaccugcaccgugagcgggggcuccaucagcaacuccuucuggggguggauccggcagccgcccggcgaggggcucgaguggaucggcuacguguacaacagcggcaacacgaaguacaaccccucccucaagagccgcgucaccaucucccgggacaccagcaagucccagcuguacaugaagcugcgcagcgugaccgccgccgacacggcgguguacuacugcgcccggcacgacgacgccucccacggguacagcaucuccuggggccacgggacccuggucaccgugagcucc

SEQ ID NO: 12553 - RNA, 357 nt, Artificial Sequence
  derived and/or modified sequence opt1 from anti-influenza_Chain
gaggugcaccuccagcagagcggccccgagcuggucaagccgggggccuccgugaagaugagcugcgaggccuccggcuacaccuucaccgacuacuacguggcgugggucaagcagagccccggggaguccuucgaguggaucggccgcgugaaccccuacagcgggggcacguccuacaaccagaaguucaagggcaaggccacccugaucguggacaagagcuccagcaccgccuacauggagcuguccagccucaccuccgaggacagcgccgucuacuacugcgcccggugggacuacgggguguacgagggcuacaucgacuacugggggcagggcuccgcgcugacggug

SEQ ID NO: 12554 - RNA, 360 nt, Artificial Sequence
  derived and/or modified sequence opt1 from anti-influenza_Chain
caggugcagcugguccagcccggcgccgaggugaagaagccggggagcuccgugaaggucagcugcaaggccuccggcgggaucuucagccccuacgcgaucuccugggugcgccaggcccccggccaggggcucgaguggaugggcggcaucaucgccaucuucgggaccaccaacuacgcccagaaguuccagggccgggugacgaucaccgccgacaagagcaccaccacggcguaccuggagcugaacucccuccgcuucgaggacaccgccgucuacuacugcgcccgcgggggccgguacuacguggacuacuucgacuacugggggcagggcacccuggugagcgucuccagc

SEQ ID NO: 12555 - RNA, 360 nt, Artificial Sequence
  derived and/or modified sequence opt1 from anti-influenza_Chain
caggugcagcugcaggagagcggccccgaccucgucaagccgggggccuccgugaagaugagcugcaaggccuccggcuacagcuucaccuacuaccacaugcacugggugaagcagacccacgggaagucccuggaguggaucggccgcauccccuacaacgggggcacgaacuacagccagcgguucaagggcaaggcggucuucaccguggacauguccagcuccaccgccuacauggagcugcgcagccucaccuccgaggacagcgccguguacuacugcgcccgggacgccaacuacgagggggacugguacuucgacgucuggggccaggggacgaccgugaccguguccagc

SEQ ID NO: 12556 - RNA, 360 nt, Artificial Sequence
  derived and/or modified sequence opt1 from anti-influenza_Chain
caggugcagcugguccagagcggcgccgaggugaaggagcccggguccgccaugaaggugagcugcaaggcguccggcgggaccuucagcuccgacgccuucugcuggguccgccaggccccgggccgggggcucgaguggaugggcggcaucauccccguguuccagaccgccaacuacgggcccaacuuccagggccgcgugacgaucagcgccgacgucuacaccaccacccuguaccuggagcucuccgggcugacgagcgaggacaccgcgguguacuucugcgcccgguccggcgacggguacaacuacuacuucccccuguggggccagggcacccucgugaccgucagcucc

SEQ ID NO: 12557 - RNA, 360 nt, Artificial Sequence
  derived and/or modified sequence opt1 from anti-influenza_Chain
cagaucacccugcgcgagagcggccccacccucgugaagccgacgcagacccugacccugaccugcacguucuccggguucagccucuccaccaacggcgucaacgugggguggauccggcagccgcccggcaaggcccuggaguggcuggcccucaucuacugggacgacgacaagcgcuacagccccucccugaagcggcgccugaccaucaccaaggacacgagcaagaaccaggugguccucacccugaccaacauggaccccguggacaccgcgacguacuacugcgcccaccggcccgacuucuacggggacuucgaguacuggggccccggcacccuggugaccgucuccagc

SEQ ID NO: 12558 - RNA, 360 nt, Artificial Sequence
  derived and/or modified sequence opt1 from anti-influenza_Chain
caggugcagcugguccagagcggcuccgaggugaagaagcccgggaccagcgugaaggucuccugcaccgccagcggcuccguguucacgaacuacgggaucagcugggugcgccaggccccgggccaggggcucgaguggaugggcggcaucaucccccuguucggggccgccaaguacgcccagaaguuccagggccgggucaccaucaccgccgacgaguccaccaagacgguguacauggagcugagccgccucaccuccaaggacaccgccaucuacuucugcgcgaaggcgccccggguguacgaguacuacuucgaccagugggggcagggcacccccgucacggugagcucc

SEQ ID NO: 12559 - RNA, 360 nt, Artificial Sequence
  derived and/or modified sequence opt1 from anti-influenza_Chain
caggugcagcugguccagagcggcgccgaccucaagaagcccggggccuccgugaaggugagcugcaaggcguccggcuacaccuucaccgacuacuacauccacuggguccgccaggccccggggcagggccuggaguggaugggguggaucaaccccgagagcggcgacacgaaguacgcccagaaguuccagggccgggugaccaugacccgcgacaccuccaucacgaccgccuacauggagcuggggcggcuccgcagcgacgacaccgccguguacuacugcgcgcgggacgucuccaccacguggagcugguucgcccccuggggccaggggacccuggugaccguguccagc

SEQ ID NO: 12560 - RNA, 360 nt, Artificial Sequence
  derived and/or modified sequence opt1 from anti-influenza_Chain
caggugcagcugcaggagagcggccccgggcucgucaagccguccgagacccugagccugaccugcuccgugagcggcggguccaucaacuacuacuacuggagcuggauccgccagccgcccggcaaggggcucgagugcaucggcuacaucuccgacacgggccggaccuacuacaaccccagccugcgcucccgggugaccaucagcgucgacaccuccaagaaccaguucagccugaaccucacguccaugaccgccgccgacaccgcgguguacuacugcgcccgcgaccccaccgggagccggcagaagaacgccuucgacauguggggccaggggacgauggugaccgucucc

SEQ ID NO: 12561 - RNA, 360 nt, Artificial Sequence
  derived and/or modified sequence opt1 from anti-influenza_Chain
caggugcagcugcaggagagcggcccccgcgucgugcggccguccgagacccucagccugaccugcacgguguccgggggcagcaucuccagcuacaacuggaucuggauccgccagccgcccgggaagggccuggaguggaucgggcacaucuacgacuacggccggaccuucuacaacuccagccuccagucccgccccaccaucagcgucgacgccuccaagaaccagcugagccugcggcucaccuccgugacggccagcgacaccgcgguguacuacugcgcccgcccccugggcauccugcacuacuacgccauggaccucugggggcagggcaccaccgucacgguguccagc

SEQ ID NO: 12562 - RNA, 360 nt, Artificial Sequence
  derived and/or modified sequence opt1 from anti-influenza_Chain
caggugcagcugcaggagagcggccccgggcuggucaagcccuccgagacccugagccugaccugcuccgugagcggcggguccaucagcuccgacuucuggagcuggauccgccagccgcccggcaaggggcucgaguggaucggcuacguguacaaccggggcuccacgaaguacagccccucccucaagagccgcgucaccaucuccgccgacaugagcaagaaccaguucucccugaacaugagcuccgugaccgccgcggacaccgccguguacuacugcgccaagaacgggcggagcuccacgagcuggggcaucgacgucugggggaagggcaccaccgugaccgugagcucc

SEQ ID NO: 12563 - RNA, 360 nt, Artificial Sequence
  derived and/or modified sequence opt1 from anti-influenza_Chain
caggugcagcugcaggagagcggccccgggcucgucaagccguccgagacccugagccugaccugcacgguguccggcgggagcaucuccgccuaccacuggagcuggauccgccagccgcccggcaaggggcucgaguggaucggccacaucuucgacuccggcagcaccuacuacaaccccucccucaagagccgggugaccaucucccuggacgccagcaagaaccagcugucccugcgccugaccagcgucacggcguccgacaccgccaucuacuacugcgcccggccccucgggagccgcuacuacuacggcauggacgugugggggcagggcaccaccgugacggucuccagc

SEQ ID NO: 12564 - RNA, 360 nt, Artificial Sequence
  derived and/or modified sequence opt1 from anti-influenza_Chain
gaggugcagcuggucgagagcggcgggggccucgugcagcccgggggcucccugcgcaucagcugcgccgccuccggguucaccgugagcuccaacuacaugagcuggguccggcaggcgccgggcaagggccuggaguggguguccgugaucuacagcgggggcuccaccuacuacgccgacagcgucaaggggcgcuucuccuucagccgggacaacuccaagaacacgguguuccuccagaugaacagccugcgcgccgaggacaccgccguguacuacugcgcccggugccugucccgcaugcggggcuacgggcucgacgucuggggccagggcaccaccgugacggugagcucc

SEQ ID NO: 12565 - RNA, 360 nt, Artificial Sequence
  derived and/or modified sequence opt1 from anti-influenza_Chain
caggugcagcugcaggagagcggccccgggcucgucaagccguccgagacccugagccugaccugcacgguguccggcagcuccaucagcaacuacuacugguccuggauccgccagagccccgggaagggccucgaguggaucggguucaucuacuacggcggcaacaccaaguacaaccccucccucaagagccgggugaccaucucccaggacaccagcaagucccaggucagccugacgauguccagcgugaccgccgccgaguccgcgguguacuucugcgcccgcgccagcugcuccgggggcuacugcauccuggacuacugggggcagggcacccuggucaccgugagcagc

SEQ ID NO: 12566 - RNA, 360 nt, Artificial Sequence
  derived and/or modified sequence opt1 from anti-influenza_Chain
caggugcagcugcagcagagcggcgccgaggucaagaagcccggguccagcgugaagguguccugcaaggucagcggcgugaucuucuccgggagcgccaucuccugggugcgccaggcgccgggccaggggcucgaguggaugggcggcaucagcccccuguucgggaccaccaacuacgcccagaaguuccagggccgggucacgaucaccgccgaccaguccaccaacaccacguacauggaggugaacagccugcgcuacgaggacaccgccguguacuucugcgcccgggggcccaaguacuacuccgaguacauggacgucuggggcaaggggaccaccgugacggugagcucc

SEQ ID NO: 12567 - RNA, 360 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaccuucuccagcuacgcgaucuccugggugcgccaggccccgggccaggggcucgaguggaugggcggcaucauggggauguucggcaccacgaacuacgcccagaaguuccaggggcgggugaccaucaccgccgacgaguucaccagcgccgcguacauggagcugcgcucccugcggagcgaggacacggccgucuacuacugcgcccgcuccagcggcuacuaccccgaguacuuccaggacugggggcagggcacccucgugaccguguccagc

SEQ ID NO: 12568 - RNA, 360 nt, Artificial Sequence
  derived and/or modified sequence opt1 from anti-influenza_Chain
cagaugcagcuggugcagagcggcgccgaggucaagaagcccggguccagcgugaagguguccugcaaggccagcggcgggaccuucuccagcuacgcgaucaccuggguccgccaggccccgggccaggggcucgaguggaugggcggcaucaucgggauguucggcuccacgaacuacgcccagaacuuccaggggcgggugaccaucaccgccgacgagagcaccuccacggccuacauggagcugagcucccugcgcagcgaggacaccgcgguguacuacugcgcccgguccaccggcuacuaccccgccuaccuccaccacugggggcagggcacccuggucacggugagcucc

SEQ ID NO: 12569 - RNA, 360 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacggcaucuccugggugcgccaggcgccggggcagggccucgaguggaugggcgacaucaucgggauguucggcagcaccaacuacgcccagaacuuccaggggcggcugacgaucaccgccgacgaguccaccagcaccgccuacauggagcuguccagccuccgcuccgaggacacggccguguacuacugcgcgcggagcuccggcuacuaccccgccuaccugccccacugggggcagggcacccuggucaccgugagcucc

SEQ ID NO: 12570 - RNA, 360 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacgcgaucuccugggugcgccaggccccgggccaggggcucgaguggaugggcggcaucaucgggauguucggcaccgccaacuacgcccagaaguuccaggggcgggugacgaucaccgccgacgaguucaccagcaccgcguacauggagcuguccagccugcgcuccgaggacacggccgucuacuacugcgcccggggcaacuacuacuacgagagcucccucgacuacugggggcagggcacccuggugaccgugagcucc

SEQ ID NO: 12571 - RNA, 360 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggccguuccgcaacuucgcgaucaacugggugcggcaggcccccggccaggggcucgaguggaugggcggcaucaucgccguguucgggaccaccaaguacgcccacaaguuccagggccgcgucacgaucaccgccgacgacuccaccaacaccgcguacauggagcuggggagccugaaguccgaggacacggccguguacuacugcgcccggggcccccacuacuacagcuccuacauggacguguggggcgaggggaccaccgucaccgugagcucc

SEQ ID NO: 12572 - RNA, 360 nt, Artificial Sequence
  derived and/or modified sequence opt1 from anti-influenza_Chain
gagguggcccuggucgagaccggcgccgaggugaagaagcccgggagcuccgugaaggucccgugcaagagcuccggcagccccuuccgcuccaacgcggugagcugggugcggcaggcccccgggcagggccucgagugggucgggggcauccugggcguguucgggucccccagcuacgcccagaaguuccagggccgcgugaccaucacggccgacgaguccaccaacaccguccacauggagcugcgggggcuccgcagcgaggacaccgccguguacuacugcgcgcggggcccgacguacuacuacuccuacauggacgugugggggaagggcaccaccgucaccgugagcucc

SEQ ID NO: 12573 - RNA, 360 nt, Artificial Sequence
  derived and/or modified sequence opt1 from anti-influenza_Chain
cagaugcagcuggugcagagcggcgccgaggucaagaagcccggguccagcgugaagguguccugcaaggccagcggcgggaccuucuccagcuacgcgaucuccuggguccgccaggccccgggccaggggcucgaguggaugggcggcaucuucgggauguucggcaccgccaacuacgcccagaaguuccaggggcgggugacgaucaccgccgacgaguucaccagcgcggccuacauggagcuguccagccugggcuccgaggacaccgccauguacuacugcgcccgcagcuccggguacuacccccaguacuuccaggacuggggccagggcacgcucgugaccgucagcucc

SEQ ID NO: 12574 - RNA, 360 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgugaccuucuccuacuacgcgaugagcugggugcgccaggccccggggcagggccucgaguggaugggcgggaucucccccauguucggcaccacgaccuacgcccagaaguuccaggggcgggucaccaucaccgccgacgacagcacguccaccgccuacauggaggugcgcagccugcgguccgaggacaccgcgguguacuacugcgcccgcagcuccaacuacuacgacagcgucuacgacuacuggggccaggggacccuggugacgguguccagc

SEQ ID NO: 12575 - RNA, 360 nt, Artificial Sequence
  derived and/or modified sequence opt1 from anti-influenza_Chain
gaggugcagcuggucgagaccggcgccgaggugaagaagcccgggagcuccgugaaggucccgugcaagagcuccggcagccccuuccgcuccaacgccgugagcugggugcggcaggcgcccgggcagggccucgagugggucgggggcauccugggcguguucgggucccccagcuacgcccagaaguuccagggccgcgugaccaucacggccgacgaguccaccaacaccguccacauggagcugcgggggcuccgcagcgaggacaccgccguguacuacugcgcccggggcccgacguacuacuacuccuacauggacgugugggggaagggcaccaccgucaccgugagcucc

SEQ ID NO: 12576 - RNA, 360 nt, Artificial Sequence
  derived and/or modified sequence opt1 from anti-influenza_Chain
caggugcaccugguccagagcggcgccgaggugcgcaagcccggggccuccgugaaggucagcugcaagguguccggcuacacccucaacgagcugagcauccacuggcugcggcaggcgccggggcgcggccucgaguggaugggguccuucgaccccgaggacggcgagaccaucuacgcccagaaguuccagggccgggugacgaugaccggggacaccagcaccgacacggccuaccuggagcugaccucccuccgcagcgaggacaccgcccuguacuacugcgcccggggcuggggcgcggucaccucccccuucgacuucugggggcaggggacgcuggugaccgugagcucc

SEQ ID NO: 12577 - RNA, 360 nt, Artificial Sequence
  derived and/or modified sequence opt1 from anti-influenza_Chain
gaggugcagcugguccagagcggcgccgaggugaagaagcccggguccagcaugaagguguccugcaaggccagcggcuccaucuucagcaacuacgggaucuccuggguccgccaggcgccgggccaggggcucgaguggaugggcggcaucauccccaucuucggggccgccaacuacgcccagaaguuccagggccgggugaccaucaccgccgacgagagcacguccaccguguacauggagguccgcagccugcgguccgaggacaccgcgguguacuacugcgcccgccggcagcagcuguacaagggguacuaccaccacuggggccaggggacccucgugacggucagcucc

SEQ ID NO: 12578 - RNA, 360 nt, Artificial Sequence
  derived and/or modified sequence opt1 from anti-influenza_Chain
caggugcagcugguccagagcggcgccggggugaagaagcccggcuccagcaugaagguguccugcaaggccagcggguccaucuucagcaacuacggcaucuccuggguccgccaggcgccggggcagggccucgaguggaugggcgggaucauccccaucuucggcgccgccaacuacgcccagaaguuccaggggcgggugaccaucaccgccgacgagagcacguccaccguguacauggagguccgcagccugcgguccgaggacaccgcgguguacuacugcgcccgccggcagcagcuguacaagggcuacuaccaccacugggggcagggcacccucgugacggucagcucc

SEQ ID NO: 12579 - RNA, 360 nt, Artificial Sequence
  derived and/or modified sequence opt1 from anti-influenza_Chain
caggugcagcugcaggagagcggccccgggcucgucaagccguccgagacccugagccugaccugcacgguguccggcgggcucaucggcaccgggagcuacuacuggggcuggauccgccagacccccggcaaggggauggaguggaucggcuccaucagcuacuccgggagcaccuacuaccaccccucccucaagagccgggugacgaucuccgacgacaccagcaagaaccagcuguuccugaagcugcgcuccgucaccgccgccgacaccgcgcaguacuacugcgcccgguacaacuggggcauccgcuacuucgacuucugggggcggggcacgcuggugaccgugagcucc

SEQ ID NO: 12580 - RNA, 360 nt, Artificial Sequence
  derived and/or modified sequence opt1 from anti-influenza_Chain
caggugcagcugguccagagcggcgccgaggugcgcaagcccggguccagcgugaaggucuccugcaaggugagcggcgggaucauccggaaguacgccaucaacugggugcgccaggcgccgggccaggggcucgaguggaugggcggcaucaucgccaucuucaacaccgccaacuacgcccagaaguuccaggggcgggucaccaucacggccgacgaguccaccagcaccguguacauggagcuguccagccugcgcuccgaggacaccgcgcucuacuacugcgcccggggcaugaacuacuacagcgacuacuucgacuacugggggcagggcucccuggugacggucagcccc

SEQ ID NO: 12581 - RNA, 360 nt, Artificial Sequence
  derived and/or modified sequence opt1 from anti-influenza_Chain
caggugcagcugguccagagcggcgggggcguggugcagcccgggcgcucccuccggcugagcugcgccgccuccggcuucaccuuccgcagccacgcgaugcacuggguccggcaggccccggggaagggccccgaguggguggcccugaucuccuacgacgaggugaacaaguucuacgccgacagcgucaagggccgcuucaccaucucccgggacgugagcaagaacacgguguuccuccagaugaacucccugagcgccgacgacaccgcggucuacuacugcgcccgcgggcacuccggcagcuaccggcuguucgacuucugggggcagggcacccucgugaccguguccagc

SEQ ID NO: 12582 - RNA, 360 nt, Artificial Sequence
  derived and/or modified sequence opt1 from anti-influenza_Chain
caggugcagcuggucgagagcggcgggggccucgugcagcccgggggcucccugcgccugagcugcgccgccuccggguucaucuucggcgacuucgcgauccacugggugcggcaggccagcggcaaggggcucgagugggucgcccgcauccgguccggccugaaccgcuucgagaccgccuacgccgcgagcguggaggggcggcugaccaucucccgcgacgacagcaaguccauggccuaccuccagaugaacaacgugaaggccgaggacacggccgucuaccugugcaccuaccuggugggcgcggugggguuccagcacuggggccagggcacccucgucaccgugagcucc

SEQ ID NO: 12583 - RNA, 360 nt, Artificial Sequence
  derived and/or modified sequence opt1 from anti-influenza_Chain
caggugcagcuggucgagagcggcgggggcguggugcagcccgggcgcucccuccggcugagcugcgccgccuccggcuucaccuucagcuccuacgggaucuacuggguccgccaggcgccgggcaagggccuggaguggguggccuucaucagcuacgacgagaucaacaaguucuacgccgacuccgugaaggggcgguucaccaucagccgcgacaacuccaagaacacggucuuccuccagaugaacagccugcgggacgaggacaccgccguguacuacugcgccaagccccugcgcggcuccuaccgguacuucgaccucugggggcgcggcaccguggucaccgugagcucc

SEQ ID NO: 12584 - RNA, 363 nt, Artificial Sequence
  derived and/or modified sequence opt1 from anti-influenza_Chain
caggugcagcugcaggagagcggccccgaccucgucaagccgggggccuccgugaugaucagcugcaaggccuccggcuacagcuucaccuacuacuacaugcacugggugaagcagucccacgggaagacccuggaguggaucggccgcaucuaccccuacaacggggacacgaacuacaaccggcgcuucaaggacaaggcgauccugaccgucgacgagagcuccagcaccgccuacauggagcuccggucccugaccagcgaggacuccgccguguacuucugcgcccgcgacgccaacuacgagggcgacugguacuucgacguguggggccaggggacgaccgucaccgugagcucc

SEQ ID NO: 12585 - RNA, 363 nt, Artificial Sequence
  derived and/or modified sequence opt1 from anti-influenza_Chain
caggugcagcugguccagagcggcgggggcguggugcagcccgggcgcucccuccggcugagcugcgccgccuccggcuucaccuucagcuccuacgcgaugcacuggguccgccaggccccggggaagggccuggaguggguggccaucaucagcuacgacggcaacgaccaguacuacaccgacuccgugaaggggcgguucacgaucagccgcgacuccagcaaggucuaccuccagaugcaccggcugcgccccgaggacaccgccguguacuacugcgccaaggaguucgagaccuccggcuacuuccacgggagcuucgacuacuggggccaggggauccuggugaccgucuccagc

SEQ ID NO: 12586 - RNA, 363 nt, Artificial Sequence
  derived and/or modified sequence opt1 from anti-influenza_Chain
caggugcaggucgugcagagcggcgccgaggugaagaagcccggguccagcguccgcguguccugccaggccagcggcgggaccuucaugaacuacgcgaucaucugggugcggcgcgccccgggccaggggcuggaguggaugggcggcaucauccccgucuuccccacccccaacuacgcccagauguuccaggggcgggugacgaucuccaccgacgagagccgcuccaccagcuuccucgagcugaccaaccugcgguacgaggacacggccguguacuacugcgcccgccggaucuaccacggcgggaacuccggcuucgacuucugggggcagggcacccucgucaccgugagcucc

SEQ ID NO: 12587 - RNA, 363 nt, Artificial Sequence
  derived and/or modified sequence opt1 from anti-influenza_Chain
caggugcagcugcaggagagcggccccgggcuccugaagcccuccgacacccuggcccugaccugcacggucagcggcggguccaucaccagcgacuacugguccuggauccgccagccgcccggccgggggcuggacuggaucggcuucuucuacaacggcgggagcaccaaguacaaccccucccucaagagccgcgugaccaucuccgccgacacgagcaagaaccagcucucccugaagcugaccagcgugaccgcggccgacaccggcgucuacuacugcgcccggcacgacgccaaguucuccgggagcuacuacguggccuccuggggccaggggacgcgcgugaccgucagcucc

SEQ ID NO: 12588 - RNA, 363 nt, Artificial Sequence
  derived and/or modified sequence opt1 from anti-influenza_Chain
caggugcagcugcaggagagcggccccgggcuccugaagcccuccgacacccuggcccugaccugcacggucagcggcggguccaucaccagcgacuacugguccuggauccgccagccgcccggccgggggcuggacuggaucggcuucuucuacaacggcgggagcaccaaguacaaccccucccucaagagccgcgugaccaucuccgccgacacgagcaagaaccagcucucccugaagcugaccagcgugaccgcggccgacaccggcgucuacuacugcgcccggcacgacgugaaguucuccgggagcuacuacguggccuccuggggccaggggacgcgcgucaccgugagcucc

SEQ ID NO: 12589 - RNA, 363 nt, Artificial Sequence
  derived and/or modified sequence opt1 from anti-influenza_Chain
caggugcagcugcaggagagcggccccgggcucgucaagcccuccgagacccugagcgugaccugcaagguguccggcgacagcaucuccagcuacuccuggagcuggauccgccagccgcccgggaagggccuggagugggucggguaccucuacuacuccggcagcacgaaguacaaccccucccucaagagccggaccaccaucuccguggacaccagcacgaaccagcugucccugaagcugagcuucgugaccgccgccgacaccgcggucuacuucugcgcccgcaccggcuccgagagcacgaccggguacggcauggacgugugggggcagggcaccaccgugacggucuccagc

SEQ ID NO: 12590 - RNA, 363 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcucc

SEQ ID NO: 12591 - RNA, 363 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcucc

SEQ ID NO: 12592 - RNA, 363 nt, Artificial Sequence
  derived and/or modified sequence opt1 from anti-influenza_Chain
gaggugcagcuggucgagaccggcgccgaggugaagaagcccggggccagcgugaaggucuccugcaaggcgagcggcuacaccuucacguccuacuacaugcacugggugcgccaggccccggggcagggccucgaguggaugggguggaucaaccccaacagcggcggcaccaacuacgcccagaaguuccaggggcgggugaccaugacccgcgacacguccaucagcaccgccuacauggagcugucccggcugcgcagcgacgacaccgccgucuacuacugcgcgcgggagggcaagugggggccccaggccgccuucgacaucuggggccaggggaccauggugacgguguccagc

SEQ ID NO: 12593 - RNA, 363 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccuucuacagcauguccugggugcggcaggcgccgggccaggggcucgaguggaugggcggcaucauccccauguucgggaccacgaacuacgcccagaaguuccagggccgggugaccaucaccgccgucgagagcaccuccacggccuacauggaggugagcucccugcgcagcgaggacaccgccguguacuacugcgcgcgcggggacaagggcaucuacuacuacuacauggacgucugggggaagggcaccaccgugacgguguccagc

SEQ ID NO: 12594 - RNA, 363 nt, Artificial Sequence
  derived and/or modified sequence opt1 from anti-influenza_Chain
gaggugcagcuggucgagaccggcgccgaggugaagaagcccgggagcuccgugaaggucagcugcaaggccuccggcgggaccuuccgcacgcacgcgaucagcugggugcggcaggccccgggccaggggcucgaguggaugggcggcaucaucgccaucuucgggaccgccaacuacgcccagaaguuccagggccgcaucaccaucaccgcggacgaguccacgagcaccgccuacauggagcuguccagccugcgguccgaggacaccgccguguacuucugcgcccgcgggagcggcuaccacaucuccacccccuucgacaacugggggcagggcacgcucgucaccgugagcucc

SEQ ID NO: 12595 - RNA, 363 nt, Artificial Sequence
  derived and/or modified sequence opt1 from anti-influenza_Chain
gaggugcagcugguccagagcggcgccgaggugaagaagcccggguccagcgugaaggucuccugcaaggccagcggcgggaucuuccgcuccaacagcaucuccugggugcggcaggcgccgggccaggggcucgaguggaugggcggcaucuucgcccuguucgggaccaccgacuacgcccagaaguuccagggccgcgugacgaucaccgccgacgagagcuccaccaccgucuaccuggagcucagcucccugacgagcgaggacaccgccguguacuacugcgcgcggggguccggcuacaccacccgcaacuacuucgacuacugggggcagggcacgcuggugaccgucagcucc

SEQ ID NO: 12596 - RNA, 363 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaucuucaacuccuacgcgaucagcugggugcgccaggccccgggccaggggcucgaguggaugggcggcaucaucgccaucuuccacacccccaaguacgcccagaaguuccaggggcgggugaccaucacggccgacgaguccaccaacaccgcguacauggagcugcgcagccugaaguccgaggacaccgcccucuacuacugcgcccggggcagcacguacgacuucuccagcgggcuggacuacuggggccaggggacccuggucaccguguccagc

SEQ ID NO: 12597 - RNA, 363 nt, Artificial Sequence
  derived and/or modified sequence opt1 from anti-influenza_Chain
caggugcagcugguccagagcggcgccgaggugaagaagcccggguccagcgugaaggucuccugcaagagcuccggcgggaacuucaacaacuacgccgugagcugggugcgccaggcgccgggccaggggcucgaguggaugggcggcaucucccccaucuucgggagcaccaaccacgcccagaaguuccagggccgggucaccaucuccgccgacaucuucacgaacaccgccuacauggagcugagcucccugcgcagcgacgacaccgccaucuacuacugcgcgcgggggcgcggcuacuacuucuaccacgccauggacgugugggggcagggcuccaccgugacggucagcucc

SEQ ID NO: 12598 - RNA, 363 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaccuucaacaacuacgcgaucaacugggugcgccaggccccgggccaggggcucgaguggaugggcggcaucucccccaucuucgggagcgugaacuacgcccagaagcugcagggccgggucaccaucacggccgacguguucaccuccaccgccuacauggagcugagcucccuccgcagcgaggacaccgcgguguacuacugcgccaagggguccggcuacuacuacuacuacgggcuggacgucuggggccugggcacgaccgugaccgugagcucc

SEQ ID NO: 12599 - RNA, 363 nt, Artificial Sequence
  derived and/or modified sequence opt1 from anti-influenza_Chain
caggugcagcuggucgagagcggcgggggcguggugcagcccgggcgcucccuccggcugagcugcgccgccuccggcuucaccuucaccaacuacgcgaugcacuggguccgccaggccccggggaagggccuggaguggguggccgugaucagcuucgacgaggacaacaaguccuacgccgacuacgucaagggccgguucacgaucagccgcgacaacuccaacaaccggcucuaccugcagaugaacagccugcgcgccgaggacaccgcgguguacuacugcgcccgggggcccgagggcgugugggggcgcuccaucgacagcuggggccaggggacccucgucaccguguccagc

SEQ ID NO: 12600 - RNA, 363 nt, Artificial Sequence
  derived and/or modified sequence opt1 from anti-influenza_Chain
caggugcagcugguccagagcggcggggaccucgugcagcccggcgggucccugcgccugagcugcgccgccuccggcuucaccuucagccgguacuccaugaacugggugcgccaggcgccggggaugggccucgagugggucgccuacaucagcgacaccucccggacgaucuacuacgccgacagcgugaagggccgcuucaccaucucccgggacaacgccaagaacagccuguaccugcagaugaagucccuccgcgacgaggacaccgccguguacuacugcgcgcgggaccccgacacccccuucguccgcgccuucgacagcugggggcagggcacgcuggugaccguguccagc

SEQ ID NO: 12601 - RNA, 363 nt, Artificial Sequence
  derived and/or modified sequence opt1 from anti-influenza_Chain
caggugcagcuggucgagagcggcgggggccucgugcagcccgggggcucccugcgccugagcugcguggccuccggguucaccuucagccgguucuccaugaacuggguccgccaggccccgggcaugggccucgagugggugagcuacaucuccgacaccgggcggacgaucuacuacgcggacagcgugaagggccgcuucaccaucucccgggacaacgacaagaacacccuguaccugcagaugaagucccuccgcgacgaggacagcgccuucuacuacugcgcccgggaccccgacacccccuucguccgcgccuucgacagcugggggcagggcgugcuggugacggucuccagc

SEQ ID NO: 12602 - RNA, 363 nt, Artificial Sequence
  derived and/or modified sequence opt1 from anti-influenza_Chain
caggugcagcugcaggagagcggccccgaccucgucaagccgggggccuccgugaagaugagcugcaaggccuccggcuacagcuucaccuacuaccacaugcacugggugaagcagacccacgggaagucccuggaguggaucggccgcaucuaccccuacaacgggggcacgaacuacagccagcgguucaagggcaaggcggucuucaccguggacauguccagcuccaccgccuacauggagcugcgcagccucaccuccgaggacagcgccguguacuacugcgcccgggacgccaacuacgagggggacugguacuucgacgucuggggccaggggacgaccgugaccguguccagc

SEQ ID NO: 12603 - RNA, 366 nt, Artificial Sequence
  derived and/or modified sequence opt1 from anti-influenza_Chain
cagggccagcuggugcagagcggggccgaggucaagaaguccggcagcuccgugaaggugagcugcaagaccuccgggggcaccuucaacagccacgccaucuccuggguccgccaggcgcccgggcagggccucgaguggaucggcgggaucaucccgauguucggcacgaccaacuacgcccagaagcugaaggggcggaucgccaucaccgccgaccagcugcccaccacggccuaccucgagcugagcucccugcgcagcgaggacaccgcgguguacuacugcgcccggggccagcgcuacuacuacgaccgggacgggauggacguguggggccagggcaccauggucaccguguccagc

SEQ ID NO: 12604 - RNA, 366 nt, Artificial Sequence
  derived and/or modified sequence opt1 from anti-influenza_Chain
caggugcaccugguccagagcggcgccgaggugaagaagcccggguccagcgugcgccucuccugcagcgccuccggcgggccguucagcggcuucgcgaucuccuggcugcggcaggcccccgggcagggccuggaguggcucggcgggaucagcgccgucuucggcaccgccaccuacgcccagaaguuccaggggcgcgugacgaucaccgcggaccaguucaccuccaccagccacauggaccugucccggcugacguacgacgacaccgccguguacuacugcgcccgcagcggcggguaccucccccagaacaacuggaucgaccccuggggccagggcacccuggucaucguguccagc

SEQ ID NO: 12605 - RNA, 366 nt, Artificial Sequence
  derived and/or modified sequence opt1 from anti-influenza_Chain
caggugcagcugguccagagcggcgccgaggugaagaaggccggguccagcgugaaggucuccugccagagcuccggcgugaccuucagcauguacgcgguguccuggguccgccaggcccccgggcagggccucgaguggaugggcgggaucaucccgcuguucggcaccacgaccuacgcccagaaguucgaggggcggcugaccaucaccgccgacacgagcaccaacauggccuaccucgagcugcgcucccugcggagcgaggacaccgcgguguacuucugcgcccgcgccggcaccacggugacccgguucaacugguucgaccccugggggcagggcacccucgucaccguguccagc

SEQ ID NO: 12606 - RNA, 366 nt, Artificial Sequence
  derived and/or modified sequence opt1 from anti-influenza_Chain
caggugcagcugguccagagcggcgccgaggugaagaagcccggguccagccucaagguguccugcaaggccagcggcgucaccuucuccauguacaccaucagcugggugcgccaggcgccggggcagggccuggaguggaugggcgggaucaucccccuguucggcacggccaacuacgagcagaaguuccaggggcgggugaccaucaccgccgacaccuccacgaacaccgccuacauggagcucagcucccugcgcagcgaggacaccgccgucuacuacugcgcgcgggccggcaccacgcugacccgcuucaacugguucgaccccugggggcagggcacccucgugaccguguccagc

SEQ ID NO: 12607 - RNA, 366 nt, Artificial Sequence
  derived and/or modified sequence opt1 from anti-influenza_Chain
auggccgacaacaugaccaccacgcagaucgaguggcgcaugaagaagauggccaucggcagcuccacccacagcuccagcgugcugaugaaggacauccagucccaguucgagcagcucaagcugcggugggagagcuaccccaaccuggucaaguccaccgacuaccaccagaagcgcgagaccauccggcucgcgacggaggagcuguaccugcucagcaagcgcaucgacgacuccauccuguuccacaagaccgugaucgccaacagcuccaucaucgccgacaugaucgugagccugucccuccuggagacccuguacgagaugaaggacgucguggagguguacagccggcagugccuc

SEQ ID NO: 12608 - RNA, 366 nt, Artificial Sequence
  derived and/or modified sequence opt1 from anti-influenza_Chain
gaggugcagcugguccagagcggcgggggccucgugcagcccgggggcucccugcgccuggccugcguggucagcggguucaccgugaccuccaacuacaucacgugggugcggcaggccccgggcaagggccucgagugggucagcgugaucuacucccacgggcgcgcguacuacagcgccuccgugaacggccgguucaccaucagccgccacaccuccaagaacaccgucuaccuggagaugaacagccugcggcccgaggacacggccguguacuacugcgccgggggcgggcucgugggcggcuacgacgaguacuucuucgacuacugggggcagggcacccuggccaccgucuccagc

SEQ ID NO: 12609 - RNA, 366 nt, Artificial Sequence
  derived and/or modified sequence opt1 from anti-influenza_Chain
caggugcagcugguccagagcggcgccgaggugaagaagcccggggccuccgugaaggucagcugcaaggcguccggcuacaccuucaccggguacuacaugcacugggugcgccaggccccgggccaggggcucgaguggaugggcuggaucaaccccaacagcggcgacacgaacuacgcccagaaguuccaggggcgggugaccaugacccgcgacaccuccaucacgaccgccuacauggagcugagcucccugcggagcgacgacaccgccgucuacuacugcgcgcgcgacucccccuacagcuccagcugguccuucuucgacuacuggggccaggggccccucgugaccgugagcucc

SEQ ID NO: 12610 - RNA, 366 nt, Artificial Sequence
  derived and/or modified sequence opt1 from anti-influenza_Chain
gaggugcagcuggucgagagcggcgggggccucgugcagcccgggggcucccugcgccugagcugcgccgccuccggguucaucuuccggaacuacuggaugagcugggugcgccaggcgccgggcaagggccucgagugggucgccaacaucaagcaggacgggcgggagaaguacuacguggacucccugcgcggccgggugaacaucagccgcgacaacgccgagaacucccuguaccuccacaugaacagccugcgggucgaggacaccgccguguacuucugcgcccgcgcgcggaugguggucgugaccggggacggcuucgacgugugggggcacggcacgauggucaccguguccagc

SEQ ID NO: 12611 - RNA, 366 nt, Artificial Sequence
  derived and/or modified sequence opt1 from anti-influenza_Chain
gaggugcagcugcucgagagcggcgggggccugguccagcccgggggcucccugcgccucagcugcgccgccuccggguucgcguucagcuccuacggcaugagcugggugcggcaggcccccggcaaggggcuggaguggguguccgccuucagcggcuccgggaccagcaccuacuacgccgacuccgucaagggccgcuucacgaucagccgggacaaguccaagaacacccuguaccuccagaugaacagccugcgcgccgaggacaccgcgaucuacuacugcgccaagccgcccgggcccuacaucgugguggccggccuguucgagaacuggggccgggggacccucgucacggugucc

SEQ ID NO: 12612 - RNA, 366 nt, Artificial Sequence
  derived and/or modified sequence opt1 from anti-influenza_Chain
gaggugcagcuggucgagagcggcgggggcguggugcagcccgggcgcucccuccggcugagcugcgccgccuccggcuucagcuucuccaacuacgcgaugcacuggguccgccaggccccggggaagggccuggaguggguggcccucaucagcuucgacggcuccgacaaguacuacgccgacagcgugaaggggcgguucaccaugucccgcgacaacagcaagaacacccuguaccugcagaugaacucccuccgggccgaggacacggcggucuacuacugcgcccgcgacgagcccuacugcggcggggacugcuucgccuucgacguguggggccaggggaccauggugaccgucagc

SEQ ID NO: 12613 - RNA, 366 nt, Artificial Sequence
  derived and/or modified sequence opt1 from anti-influenza_Chain
caggugcagcugcagcagagcggccccgggcucgucaagccgucccagacccugagccugaccugcacgguguccggcgggcccgugagcggcgggggcuacuccuggaacuggauccgccagcggcccggccaggggcucgagugggucggcuucauguuccacagcgggagcccccgcuacaacccgacccugaagucccggaucaccaucuccguggacaccagcaagaaccuggugucccucaagcugagcuccgucacggccgccgacaccgcgguguacuucugcgcccgcgugggccagauggacaaguacuacgccauggacgucugggggcagggcaccaccgugacggugagcucc

SEQ ID NO: 12614 - RNA, 366 nt, Artificial Sequence
  derived and/or modified sequence opt1 from anti-influenza_Chain
caggugcagcugguccagagcggcgggggccucgugaagcccgggggcucccugcgccugagcugcgccgccuccggguucaccuucagcuccuacagcaugaacugggugcggcaggcgccgggcaagggccucgagugggucuccagcaucuccagcuccagcuccuacaucuacuacguggacagcgugaaggggcgcuucaccaucucccgggacaacgccaagaacagccuguaccugcagaugaacucccuccgcgccgaggacacggccgucuacuacugcgcccggggcgggggcagcuacggggcguacgagggcuucgacuacuggggccaggggacccuggugaccguguccagc

SEQ ID NO: 12615 - RNA, 366 nt, Artificial Sequence
  derived and/or modified sequence opt1 from anti-influenza_Chain
caggugcagcugguccagagcggcgggggcguggugcagcccgggcgcucccuccggcugagcugcgccgccuccggcuucaacuucagcuccuacgggaugcacuggguccgccaggcgccgggcaagggccuggaguggcucagcgugaucugguccgggggcagcaacaaguacuacgccgacuccgugaaggggcgguucaccaucagccgcgacgacuccaagaacaccgucuaccugcagaugaacagccugcgggacgaggacacggccguguacuacugcgcccgcgcccacaccgcgcucacccgguuccgcuggcuggaccccuggggccaggggauccuggugaccgucuccagc

SEQ ID NO: 12616 - RNA, 366 nt, Artificial Sequence
  derived and/or modified sequence opt1 from anti-influenza_Chain
caggugcagcugguccagagcggcgggggcguggugcagcgcgggcggucccuccgccugagcugcgccgccuccggcuucaccuuccggaccuacgggaugcacuggguccgccaggcgcccggcaagggccuggagugcguggcccucaucagcuacgacgggacgaacaaguacuacgccgacuccgugaagggccgguucaccaucagccgcgacaacuccaaggacacccuguaccugcagaugaacagccuccgggccgaggacaccggggucuacuacugcgccucccuggacuacgacuucagcuacuacuaccaccgcgacguguggggcccggggacgaccgugaccgucuccagc

SEQ ID NO: 12617 - RNA, 366 nt, Artificial Sequence
  derived and/or modified sequence opt1 from anti-influenza_Chain
caggugcagcuggucgagagcggcgggggccucgugcagcccgggggcucccugcgccugagcugcgccgccuccggguucaccuucagcgacuacuggaugguguggguccggcaggcgccgggcaagggccucgugugggugucccgcaucagcuccgacgggagcaccacguccuacgccgacagcgucaagggccccuucaccaucucccgggacaacgccaagaacacccuguaccugcagaugaacagccuccgcgccgaggacaccgccguguacuacugcgcgcggguggccacgcccuacuacuacgaguccggguucgacuacuggggccagggggcccuggucaccgugagcucc

SEQ ID NO: 12618 - RNA, 369 nt, Artificial Sequence
  derived and/or modified sequence opt1 from anti-influenza_Chain
caguuccagcuggugcagagcggccccgaggucaagaagccggggaccuccgugaaggugagcugcaaggccuccggcuacaccagcacgaccuacgggaucuccuggguccgccaggugcccggccaggggcucgaguggaugggcuggaucaaccccuacaacggcaacccccacuacgggcagaaguuccagggccgggugacccugacccgcgacacgagcaccaacaccgccuaccuggagauccucucccugcggagcgacgacaccgcggucuacuacugcgcccgcgacggguggggccagcagcuggugccguacuacuucgacuacugggggcagggcacgcucgugaccgucuccagc

SEQ ID NO: 12619 - RNA, 369 nt, Artificial Sequence
  derived and/or modified sequence opt1 from anti-influenza_Chain
caggugcagcuggcccagagcggcgccgaggucaagcgccccggguccagcgugaagguguccugcaccgcgagcggcgggaucuuccggaagaacgccaucuccuggguccgccaggccccgggccaggggcucgaguggaugggcggcaucaucgccguguucaacaccgccaacuacgcgcagaaguuccaggggcgggugaagaucacggccgacgagagcggcaacaccgccuacauggagcuguccagccugcgcuccgacgacaccgccgucuacuacugcgcgagccaccccaaguacuucuacggguccggcagcuaccccgacuucugggggcagggcacccucgugacgguguccagc

SEQ ID NO: 12620 - RNA, 369 nt, Artificial Sequence
  derived and/or modified sequence opt1 from anti-influenza_Chain
caggugcagcugcaggagagcggccccgggcucgucaagccguccgagacccugagccugaccugcacggugucccgcggcagcaucgggcacuacuucugguccuggauccggcagccgcccggcaaggggcucgaguggaucggcuacaucagcuacuccggcagcaccaaguacaaccccucccugcgcagccgggugaccaucuccgucgacaccagcaagaaccaguucucccugaaccucaacagcgugacggccaccgacaccgcccuguacuacugcgcgcgcgaggacuacgacauccugaccggggccggccccgggauggagguguggggccaggggacgaccgucaccguguccagc

SEQ ID NO: 12621 - RNA, 369 nt, Artificial Sequence
  derived and/or modified sequence opt1 from anti-influenza_Chain
caggugcagcugcaggagagcggccccgggcucgucaagccguccgagacccugagccugaccugcacgguguccggcgccagcaucaacucccacuacuggagcuggauccgccagccgcccgggaagggccucgaguggaucggguacguguacuacuccggcagcaccaccuacaaccccucccucaagagccgggucacccuguccguggacacgagcaagaaccaguucucccugaaccugagcuccgugaccgccgcggacaccgccuucuacuacugcgcccgccaccccuacgacguccugaccggcagcggggacugguucgaccccuggggccaggggacgcucgugaccguguccagc

SEQ ID NO: 12622 - RNA, 369 nt, Artificial Sequence
  derived and/or modified sequence opt1 from anti-influenza_Chain
caggugcagcugguccagagcggcgccgaggugaagcgccccggguccagcgugaaggucuccugcaccgccagcggcgggaucuuccggaagaacgcgaucuccugggugcgccaggccccgggccaggggcucgaguggaugggcggcaucaucgccguguucaacaccgccaacuacgcccagaaguuccagaaccgggucaagaucacggcggacgagagcgggaacaccgccuacauggagcuguccagccugaccuccgacgacaccgccguguacuacugcgccagccaccccaaguacuucuacggcuccgggagcuaccccgacuucuggggccaggggacgcucgugaccgucuccagc

SEQ ID NO: 12623 - RNA, 369 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuuccgcuccuacgcggugagcugggugcggcaggccccgggccaggggcucgaguggaugggcggcaucaucgccaucuucgggaccacgaacuacgcccagaaguuccaggaccgcgucaccaucaccgccgacgaccugcccuccaccgcguacauggagcugacgagccuccgguccgaggacaccgccguguacuucugcgugcgcggccggggguacuaccugggcggggacuacggcagccuggacuccuggggccaggggacccucgucaccgugagc

SEQ ID NO: 12624 - RNA, 369 nt, Artificial Sequence
  derived and/or modified sequence opt1 from anti-influenza_Chain
gaggugcagcuggucgagagcggcgggggccucgugcagcccgggcgcucccugcggcugagcugcgugggcuccggguucaacuucgacggcuacgccaugcaguggguccgccaggugccgggcaaggggcucgagugggugagcggcaucuccuggcacagcgacuccaccggguacgccgacagcguccggggccgcuucaccaucucccgggacaacgcgaagaacagccuguaccugcagauggacucccuccgccccgaggacacggccuucuacuacugcggcaagagcaucgggcacgugggcggguccuaccggcaccccaucgacuacuggggccaggggacccuggugaccgucagc

SEQ ID NO: 12625 - RNA, 369 nt, Artificial Sequence
  derived and/or modified sequence opt1 from anti-influenza_Chain
caggugcagcugcaggccagcggccccgggcucgucaagccguccgagacccugagccugaccugcacgguguccggcgacagcaucaccuccggggccuacuacuggaccuggauccgccagcaccccggcaaggggcucgaguggaucggcuacaucuacuacagcggcaacaccuacuacaaccccucccucaagagccgggugacgaucucccuggacaccagcaagaaccaguucucccugaaggucaacagcgugaccgcggccgacaccgccguguacuacugcgcccgcgccgcguccacgagcguccugggguacggcauggacgugugggggcagggcaccaccgugaccgucuccagc

SEQ ID NO: 12626 - RNA, 369 nt, Artificial Sequence
  derived and/or modified sequence opt1 from anti-influenza_Chain
caggugcagcugguccagagcggcgccgaggugaagaagcccggguccagcgugcgcgucuccugcaaggccagcggcuccaucuuccggaacuacgcgaugagcugggugcgccaggccccggggcagggccucgaguggaugggcgggaucaucgccaucuucggcacccccaaguacgcccagaaguuccaggggcgggugaccaucacggccgacgaguccaccagcaccgucuacauggagcuguccggccugcgcagcgaggacaccgcgauguacuacugcgcccggaucccccacuacaacuucggguccggcagcuacuucgacuacugggggcagggcacgcucgugaccguguccagc

SEQ ID NO: 12627 - RNA, 369 nt, Artificial Sequence
  derived and/or modified sequence opt1 from anti-influenza_Chain
cagcugcagcuccaggagagcggcccccgccuggugaagcccuccgagacccugagccugaccugcuccgucagcgggguguccaucagcuccagcaacuacuacuggggcuggauccggcagccgcccgggaagggccuggaguggaucgggacgaucuaccacuccggcagcaccuacuacaaccccucccucaagagccgccucaucaucuccguggacaccagcaagaaccaguucuaccugcagcugaccucccucacggccgccgacagcgcggucuacuacugcgccaccggcgggggcuucggguggucccagaccuacuucggcuacugggggcagggcacccuggugacggccagcucc

SEQ ID NO: 12628 - RNA, 369 nt, Artificial Sequence
  derived and/or modified sequence opt1 from anti-influenza_Chain
gaggugcagcugcagcagagcggccccgagcucgucaagccgggggccuccgugaagaugagcugcaaggccuccggcuacaccuucaccagcuucaucauguacugggugaagcagaagcccgggcagggccuggaguggcugggguacaucgaccccuacaacgacggcacgaaguacaacgagaaguucgagggcaaggcgacccucaccuccgacaagagcuccagcaccgccuacauggagcuguccagccugacguccgaggacagcgccgucuacuacugcgccaagcgcgggaacuacggcaacggguucgccuacuggggccaggggacccucgugaccguguccgcggccaagaccagc

SEQ ID NO: 12629 - RNA, 369 nt, Artificial Sequence
  derived and/or modified sequence opt1 from anti-influenza_Chain
caggugcagcugcucgagagcggcggggacgucgugcagcccggcaccucccugcgccugagcugcgccgccuccggguucagccucuggaccuccggcaugcacugggugcggcaggcgccggggaagggccuggagugggucgccgugaugagcuacgacgagacgaagaaguacuacgccgacuccgugcgcggccgguucagcaucucccgcgacaacagccggaacacccuguaccuccagaugaacucccugcgcgucgaggacaccgccguguacuucugcgccaagccccggcuggacuaccucgacuacuuccacgcggccgacagcugggggcagggcacccugguguccgucagcucc

SEQ ID NO: 12630 - RNA, 369 nt, Artificial Sequence
  derived and/or modified sequence opt1 from anti-influenza_Chain
caggugcagcuggucgagagcggcgccgaggugcgcaagcccggggagucccuccggaucagcugcaaggcccacggcgacuccuucaccagcuacuggaucgggugggugcgccagcugccgggcaaggggcuggaguggauggcggucaucuacccccgggacuccgagaccaaguucagccccgccuuccacggccagguguccaucagcguggacaaguccacgagcaccguccaccuccaguggaacucccugaaggccagcgacaccgccguguacuacugcgcccgcucccccggcuacagcggguaccuguacggcugguucgacccgugggggcagggcacccccgugacggucuccagc

SEQ ID NO: 12631 - RNA, 369 nt, Artificial Sequence
  derived and/or modified sequence opt1 from anti-influenza_Chain
caggugcagcuggucgagagcggccccgggcucgugaagcccuccgagacccugagccugaccugcacgguguccggcgacagcgucaucaacuccgccuacuacugggacuggauccgccagccgcccgggaagggccucgaguggguggggagcguguacuacuccggcaucaccuacuacaaccccagccugaagucccgggucaccaucagcguggacaccuccaagaaccaguucagccugcgccucuccuacgugacggccgcggacaccgcccuguacuacugcgcccggcgcggcgggggcuggcaguacuacuacgggauggacgucuggggccaggggaccaccgugacggugagcucc

SEQ ID NO: 12632 - RNA, 369 nt, Artificial Sequence
  derived and/or modified sequence opt1 from anti-influenza_Chain
caggugcagcugguccagagcggcgccgaggugaagaagcccggggccuccgugaaggucagcugcaaggcguccggcuacaucuucaccggguacuacauccacugggugcgccaggccccgggccaggggcucgaguggaugggccggaucgaccccaacggcagcgggaccacguacgcccagaaguuccagggccgcgugacccugaccauggacaccuccaucacgaccgccuacauggagcugagccggcuccgcuucgacgacaccgccaucuacuacugcgcgcggugggacuggaacuucgaccuguaccuggggugguucgaccccuggggccaggggacccccgucacgguggccucc

SEQ ID NO: 12633 - RNA, 369 nt, Artificial Sequence
  derived and/or modified sequence opt1 from anti-influenza_Chain
gaggugcagcugguccagagcggcgccgaggugaagaagcccggggccuccgugaaggucagcugcaaggcguccggcuacaucuucaccggguacuacauccacugggugcgccaggccccgggccaggggcucgaguggaugggccggaucgaccccaacggcgccgggaccacguacgcccagaaguuccagggccgcgugacccugaccauggacaccagcaucacgaccgccuacauggagcugucccggcuccgcuucgacgacaccgcgaucuacuacugcgcccggugggacuggaacuucgaccuguaccuggggugguucgaccccuggggccaggggacccccgucacgguggccagc

SEQ ID NO: 12634 - RNA, 369 nt, Artificial Sequence
  derived and/or modified sequence opt1 from anti-influenza_Chain
caggugcagcugguccagagcggcgccgaggugaagaagcccggggccuccgugaaggucagcugcaaggcguccggcuacaccuucaacgcccaccacaugcacugggugcgccaggccccggggcagggccucggguggaugggcuggaucgaccccaacaacgacggcaccaucuacgcccagaaguuccaggggcgggugacgcugaccauggacaccagcauccacaccgccuacauggagcuguccggccuccgcuacgacgacacggcgaucuacuacugcguccggugggccuggaacuucgacuucuuccuggggugguucgaccccuggggccaggggacccuggugaccguggccagc

SEQ ID NO: 12635 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgacagcgacaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagc

SEQ ID NO: 12636 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgacgccgacgcgaucuacagccccuccuuccagggccaggugaccaucagcgccgacaacuccaucagcacggccuaccugcagugguccagccucaaggccuccgacaccgccaucuacuacugcgcgagcgggcccggguacuccggcuaccacuacgggugguucgacaccuggggccagggcacccuggugacggucagcucc

SEQ ID NO: 12637 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgagagcgagaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagc

SEQ ID NO: 12638 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgacgccgacaccaucuacagccccuccuuccagggccaggugacgaucagcgcggacaacuccaucagcaccgccuaccugcagugguccagccucaaggccuccgacaccgccaucuacuacugcgccagcgggcccggguacuccggcuaccacuacgggugguucgacaccuggggccagggcacgcuggugaccgucagcucc

SEQ ID NO: 12639 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcagcuccgacaccaucuacagccccuccuuccagggccaggugacgaucagcgccgacaacuccaucagcaccgcguaccugcagugguccagccucaaggccuccgacaccgccaucuacuacugcgccagcgggcccggguacuccggcuaccacuacgggugguucgacaccuggggccagggcacgcuggugaccgucagcucc

SEQ ID NO: 12640 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgacagcgacgccaucuacucccccagcuuccagggccaggugaccaucuccgcggacaacagcaucuccacggccuaccugcaguggagcucccucaaggccagcgacaccgccaucuacuacugcgccuccgggcccggguacagcggcuaccacuacgggugguucgacaccuggggccagggcacccuggugacggucuccagc

SEQ ID NO: 12641 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgacaccgacacgaucuacagccccuccuuccagggccaggugaccaucagcgccgacaacuccaucagcaccgcguaccugcagugguccagccucaaggccuccgacaccgccaucuacuacugcgccagcgggcccggguacuccggcuaccacuacgggugguucgacacguggggccagggcacccuggugaccgucagcucc

SEQ ID NO: 12642 - RNA, 369 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugccgggcaaggggcuggaguggaucggcaugauguaccccggcgagagcgacaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagc

SEQ ID NO: 12643 - RNA, 372 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaucuucaucucccaggcgaucagcugggugcgccaggccccgggccaggggcucgaguggaugggcggcaucauccccauguucggggccaccaacuacgcccagaaguuccagggccgggugaccaucacggccgacaaguccaccaacaccgucuacauggagcugagcucccugaccagcgaggacacggcgguguacuacugcgcccgccucggguccggcagcuaccacaacgggcccaacugguucgaccccuggggccagggcacccuggugaccgucuccagc

SEQ ID NO: 12644 - RNA, 372 nt, Artificial Sequence
  derived and/or modified sequence opt1 from anti-influenza_Chain
caggugcagcugcaggagagcggccccgggcucgucaagccguccgagacccugagccugaacugcgccguguccggcgggagcaucuccaacuacuacuggagcuggauccgccagccgcccggcaaggggcucgaguggaucggcuacaucuccuacaacggccggcccaaguacaaccccagccugaccucccgcgugacgaucagcgucgacaccuccaaggaccaguucagccuggagcuccgguccgugaccgccgcggacaccgcccuguacuacugcgcccgcgagacgcgguucggggagcugcucagccccuacgacgccuucgagaucuggggccaggggaccauggugaccgucuccagc

SEQ ID NO: 12645 - RNA, 372 nt, Artificial Sequence
  derived and/or modified sequence opt1 from anti-influenza_Chain
caggugcagcugcaggagagcggccccgggcucgucaagccguccgagacccugagccugaccugcacgguguccggcgggagcguguccagcgagaccuacuacugguccuggauccggcagccgcccggcaaggggcucgaguggaucggcuacaucuacuacaucggcaacaccgacuaccggcccagccugaagucccgcgucaccaucagccuggacacguccaagaaccaguucagccucaagcuguccagcgugaccgccgccgacaccgcgguguacuacugcgcccgcggggccuacuacgacuccagcggcuaccccgccuucuacaucugggggcagggcaccauggucacgguguccagc

SEQ ID NO: 12646 - RNA, 372 nt, Artificial Sequence
  derived and/or modified sequence opt1 from anti-influenza_Chain
caggugcagcugcaggagagcggccccgggcucgucaagcccuccgagacccugagccugaccugcgccguguccggcgugagcaucuccaacaucgacuucuacuggggguggauccgccagccgcccggcaaggggcucgaguggaucggcaacaucuacuacacgggcaucaccuucuacaaccccagccuguccagccgggucgccaucuccaucgacaccagcaagaaccaguucucccugacccucacgagcgugaccgcggccgacaccgccauguacuacugcgcccgccacuacggggacuccgaggccaucaacgacgcguucgacaucuggggccaggggaccaugcugacggugagcucc

SEQ ID NO: 12647 - RNA, 372 nt, Artificial Sequence
  derived and/or modified sequence opt1 from anti-influenza_Chain
caggugcagcuggucgagagcggcgccgaggugaagaaguucggggccuccgugaaggucagcugcaaggcguccggcuacacccucaucgacuacuacaugcacugggugcgcguggcccccgggcagggccuggaguggaugggguggaucaacccgaucaacggcggcaccaacuacgcccagaaguuccaggggcgggucacgaugacccgcgacaccagcaucaacaccgccuacauggaccuguccagccuccgguccgacgacacggccauguacuacugcacccgcggccggcccaucgggcgcaacugggagccccgggacaaggacuacuggggccaggggacccccgugaccgugagcucc

SEQ ID NO: 12648 - RNA, 372 nt, Artificial Sequence
  derived and/or modified sequence opt1 from anti-influenza_Chain
caggugcagcugguccagagcggcgccgaggugaagaagcccggguccagcgugaccgucuccugcaagaccagcggccacacguucaucuccuacgccaucagcuggcuccgccaggcgccggggcagggccuggaguggaugggcgggaucgugcccaucuucggcaccgugaacuacacccagaaguuccaggggcggcugaccaucacggccgacgaguccaccagcaccgccuacauggaccucucccgccugaccuucgaggacacggccaucuacuucugcgcccgggaggcgggcuaccacagcuccuucagcggggucuacuucgacuacuggggccaggggacccugcucaccguguccagc

SEQ ID NO: 12649 - RNA, 372 nt, Artificial Sequence
  derived and/or modified sequence opt1 from anti-influenza_Chain
gaggugcagcugcagcagagcggccccgagcucgucaagccgggggccuccgugaagaucagcugcaaggccuccggcuacaccuucaccgacuacaacaugcacugggugaagcagagccuggggaagucccuggaguggaucggcuacaucuaccccaacaacgggggcacgggcuacaaccagaaguucgagagcaaggcgacccucaccgucgacaacuccagcuccaccgccuacauggagcugcgcacgcugaccagcgaggacuccgccguguacuacugcgugcggagcggggccuacuacuucaacuaccucguccccuacuucgacuacuggggccaggggaccacccugacgguguccagc

SEQ ID NO: 12650 - RNA, 372 nt, Artificial Sequence
  derived and/or modified sequence opt1 from anti-influenza_Chain
gaggugcagcugcagcagagcggccccgagcucgucaagccgggggccuccgugaagaucagcugcaaggccuccggcuacaccuucaccggguacaacaugcacugggugaagcagagccacggcaagucccuggaguggaucgggaagaucuaccccaacaacggcgucacgggcuacaaccaggaguuccgcagcaaggcgacccugaccguggacaacuccagcuccaccgccuacauggagcuccggagccugacguccgaggacagcgccaucuacuucugcgugcgcuccggggccuacuacgucaacuaccuggugcccuacuucgacuacuggggccaggggaccacccucaccgugagcucc

SEQ ID NO: 12651 - RNA, 375 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgugaccuccagcaacuacccgaucaccugggugcgccaggcgcccgggcagggccucgaguggaugggcgggguccugccccuguucggcgugacgaacuacgcccagaaguuccaggggcgggugaccaucuccgccgacaagagcaccaacaccgccuacauggagcucuccagccugcgcuccgaggacacggccgucuacuacugcgcgcggggcaagcgccccggguacugcagcggcggggugugcuccagcgacuacuggggccagggcacccuggugaccgucuccagc

SEQ ID NO: 12652 - RNA, 375 nt, Artificial Sequence
  derived and/or modified sequence opt1 from anti-influenza_Chain
caggugcagcugcaggagagcggccccgggcucgucaagccgucccagacccugagccugaccugcacgguguccggcgggagcaucuccagcggcaccuacuacugguccuggauccgccaccaccccgggaagggccucgaguggaucggcuacaucuaccacagcggguccgccuacuacaaccccagccuggagucccgggugaccaugagcgucgacaccuccaagaaccaguucagccugaagcucuccagcgugacggccgcggacaccgccaucuacuacugcgcccgcgccgagaaccugcugucccccuaccucgccgagggcuucgacccgugggggcagggcacccuggugaccgucagcucc

SEQ ID NO: 12653 - RNA, 375 nt, Artificial Sequence
  derived and/or modified sequence opt1 from anti-influenza_Chain
gaggugcagcugguccagagcggcgccgaggugaagaagcccggggagucccucaagaucagcugccaggccuccggcuacagcuucaccucccgguggaucgggugggugcggcagaugccgggcaaggggcuggagugggucggcuucaucuaccccagcgacuccgacgugcgcuacagccccuccuuccggggccaggugaccaucagcgcggacaaguccaucagcacggccuaccugcagugguccagccucaaggccuccgacaccgccauguacuucugcgcccgccucgggggcaacaaggacuacggggacuaccugugguacuucgaccuguggggccgcggggcgcuggucaccgugagcucc

SEQ ID NO: 12654 - RNA, 375 nt, Artificial Sequence
  derived and/or modified sequence opt1 from anti-influenza_Chain
caggugcagcuggucgagagcggcgggggcguggugcagcccgggcgcucccuccggcugagcugcgccgccuccggcuucaccuucagcuccuacgggaugcacuggguccgccaggcgccgggcaagggccuggaguggguggccgugaucugguacgacggggacaacaaguacuacggcgacagcgucaaggggcgguucaccaucucccgcgacaacagcaagaacacccucuuccugcagaugaacucccugcgggccgaggacacggccguguacuacugcgccaaggacaccgcggaccacggcgacuacguggaccucggguucuucgacgccuggggccagggcacccuggucacggugagcucc

SEQ ID NO: 12655 - RNA, 375 nt, Artificial Sequence
  derived and/or modified sequence opt1 from anti-influenza_Chain
gaggugcagcugguccagagcggcgccgagcucaagaugcccggggagucccugaagaucagcugcaaggccuccggcuacaccuucaccaacuacuggaucgggugggugcgccagacgccgggcaaggggcuggaguggaugggcaucaucuucccgcccgacagccagaccuccuacagccccuccuuccagggccaggugaccuucagcgucgacaacuccaucagcguggcguacauccagugguccagccucaaggccuccgacaccgccaucuacuacugcgcccggagcgggaucuucgacugguccgcgccccugguggaggccuucgacaucuggggccaggggacggucgugaccgugagcucc

SEQ ID NO: 12656 - RNA, 375 nt, Artificial Sequence
  derived and/or modified sequence opt1 from anti-influenza_Chain
gaggugcagcugguccagagcggcgccgaggugaagaagcccggggagucccucaagaucagcugcaagggcuccggguacagcuucuccgacuacuggaucggcugggugcgccagaugccgggggagggccuggaguggaugggcaucaucuaccccgccagcuccgagauccgguacagccccuccuuccaggggcuggucaccaucagcgcggacaaguccaucaacaccgccagccuccagugguccagccugaaggccuccgacacggccaucuacuacugcgcccgccacgcgagcugcuccgcccggagcugcuacuggggccccguggacuacugggggcagggcacccuggugaccgucuccagc

SEQ ID NO: 12657 - RNA, 375 nt, Artificial Sequence
  derived and/or modified sequence opt1 from anti-influenza_Chain
caggugcagcuggucgagagcggcgggggcguggugcagcccgggcgcucccuccggcugagcugcgccgccuccgagaucaccuucaucaccuacgcgaugcacuggguccgccaggccccgggcaaggggcuggaguggguggcccucaucagcgacgacggcuccaacaaguucuacgccgacagcgugaagggccgguucacgaucucccgcgacaacagcaagaacacccuguaccugcagaugaacucccuccgggccgaggacaccgcggccuacuacugcgcccgcgagggggucuacuucgacagcggcaccuaccggggguacuucgacuacuggggccaggagacgcuggugaccguguccagc

SEQ ID NO: 12658 - RNA, 375 nt, Artificial Sequence
  derived and/or modified sequence opt1 from anti-influenza_Chain
caggugcagcugcaggagagcggccccgggcucgucaagccgucccagacccugagccugaccugcacgguguccggcgggagcaucuccagcggcaacuacuacuggaacugggugcgccagcaccccgggaagggccucgaguggaucggcuacaucuacuaccggggguccaccuucuacaaccccagccugaagucccgcgucaccaucagcaucgacaccuccaagaaccaguucagccugcggcucuccagcgugacggccgccgacaccgcgguguacuacugcgccaaggacacccgcuccagccuggacaacuaccaguacggcauggacgucugggggcagggcaccacggugaccguguccagc

SEQ ID NO: 12659 - RNA, 375 nt, Artificial Sequence
  derived and/or modified sequence opt1 from anti-influenza_Chain
gaggugcagcugcucgagagcggcgggggccugguccagcccgggggcucccugcgccucagcugcgccgccuccggguucagcuucuccaccuacgcgaugagcugggugcggcaggccccgggcaagggccuggaguggguguccgggaucagcggcuccggggagagcaccuacuacgccgacuccgucaagggccgcuucacggugagccgggacaacuccaagaacacccuguaccuccagaugaacagccugcgcgccgaggacaccgccguguacuacugcgcgaagcagggggaccacaucgccuggcugcuccggggcaucaacuucgacuacuggggccaggggguccuggugaccguguccagc

SEQ ID NO: 12660 - RNA, 375 nt, Artificial Sequence
  derived and/or modified sequence opt1 from anti-influenza_Chain
caggugcagcuggucgagagcggcgggggcguggugcagcccgggcgcucccuccggcugagcugcgccgccuccggcuucgcguuccacaaccgcgccaugcacuggguccggcaggccccggggaagggccuggaguggguggcccucaucuacuucgacggcagcaagcaguacuacgccgacuccgugaaggggcgcuucaccaucagccgggacaacuccaagaacaccgucuuccugcagaugaacagccugcgccccgaggacacggcgguguacuacugcgccgugcccggccccaucuucgggaucuucccgcccugguccuacuucgaccacuggggccaggggauccucgucaccgugagcucc

SEQ ID NO: 12661 - RNA, 375 nt, Artificial Sequence
  derived and/or modified sequence opt1 from anti-influenza_Chain
gaggugcagcuggucgagagcggcgggggcguggugcagcccgggcgcucccuccggcugagcugcgccgccuccggcuucgcguuccacaaccgcgccaugcacuggguccggcaggccccggggaagggccuggaguggguggcccucaucuacuucgacggcagcaagcaguacuacgccgacuccgugaaggggcgcuucaccaucagccgggacaacuccaagaacaccgucuuccugcagaugaacagccugcgccccgaggacacggcgguguacuacugcgccgugcccggccccaucuucgggaucuucccgcccugguccuacuucgaccacuggggccaggggauccucgucaccgugagcucc

SEQ ID NO: 12662 - RNA, 375 nt, Artificial Sequence
  derived and/or modified sequence opt1 from anti-influenza_Chain
gaggugcagcugguccagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcucc

SEQ ID NO: 12663 - RNA, 375 nt, Artificial Sequence
  derived and/or modified sequence opt1 from anti-influenza_Chain
caggugcagcuggucgagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcucc

SEQ ID NO: 12664 - RNA, 375 nt, Artificial Sequence
  derived and/or modified sequence opt1 from anti-influenza_Chain
caggugcagcuggucgagagcggcgggggcguggugcagcccgggaaguccccgcgccucagcugcgccgccuccggccccaccuucagcuccuacgcgguccacugggugcggcaggcccccgggaagggccuggagugggugacccugaucagcuacgacggcgccaaccaguacuacgccgacuccgucaaggggcgcuucacgaucagccgggacaacuccaagaacaccguguaccuccagaugaacagccugcgccccgaggacaccgccguguacuacugcgcgguccccggccccguguucgggaucuucccgcccugguccuacuucgacaacuggggccaggggauccuggugaccgucagcucc

SEQ ID NO: 12665 - RNA, 375 nt, Artificial Sequence
  derived and/or modified sequence opt1 from anti-influenza_Chain
gaggugcagcuggucgagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcucc

SEQ ID NO: 12666 - RNA, 375 nt, Artificial Sequence
  derived and/or modified sequence opt1 from anti-influenza_Chain
caggugcagcugguccagagcggcgccgagcucaagcgccccggggccuccgugaaggugagcugcaagaccuccggcuacagcuucaacaacuacgggaucaacuggguccggcaggcgccgggccaggggcuggaguggaugggcuggaucuccgccuacaccggcaacacgcacuacgccaagaacuucgaggggcgcgugacccugaccaccgacacgagcaccuccaccgccuacauggaggugcggagccuccgcuccgacgacagcgccgucuacuucugcgcgcgggccaugauccagggcguggugacccuguaccugcgccccggggacuacuggggccaggggacgcucgucaccguguccagc

SEQ ID NO: 12667 - RNA, 375 nt, Artificial Sequence
  derived and/or modified sequence opt1 from anti-influenza_Chain
caggugcagcugguccagagcggcgccgaggugaagcagcccggggccuccgugaaggucagcugcaaggcguccggcuacaccuucaacgccuacuacauccacugggugcgccaggccccggggcagggccucgaguggaugggguggaucaaccccaacuucggcggcacccacuacgcccggaaguuccaggggcgcgugacgaugacccgggacgccagcaucaacaccgcguacauggagcuggaccgccugaucuccgacgacaccgccgucuacuacugcgugcgguggcgcgccgccgcggugaucauggaccaguucuacaagauggacgucuggggccaggggacgcucgugaccgugagcucc

SEQ ID NO: 12668 - RNA, 375 nt, Artificial Sequence
  derived and/or modified sequence opt1 from anti-influenza_Chain
caggugcagcugguccagagcggccccgagcucaagaagccgggguccagcgugaagcuguccugcauggccaccggcgggaccuucaucaacuacgccuucagcugggugcgccaggcgcccggccaggggcuggaguggcucggcggcaucauccccgucuacgggacguccaaccacguggagaagcugcagggccgggugaccaucaccgccgacgccagcaccaacacggccuacauggagcuguccgggcuccgcuucgacgacaccgccgucuacuucugcgcggccagcaccgccaccuccggcacguacuacgccaugcggcccuucgacuucugggggcagggcacccuggugagcguguccagc

SEQ ID NO: 12669 - RNA, 378 nt, Artificial Sequence
  derived and/or modified sequence opt1 from anti-influenza_Chain
gaggugcagcuggucgagagcggcgggggcguggugcagcccgggggcucccuccgccugagcugcaucgccuccgccuucaaccuggggaucuucggcaugcacuggguccggcaggcgccgggcaaggggcucgaguggguggccuucauccgcuacgacggcgggaagaccuucuacgccgacagcgugaagggccgguucaccaucucccgcgacaacagcaagaacacgcuguaccugcagaugaacucccuccggaccgaggacaccgcccuguacuacugcgcccgcgacgcgaccgccgacuacuacgggcccggcagcuaccccaacuggcuggaccccuggggccaggggacgcucgucaccgugucc

SEQ ID NO: 12670 - RNA, 378 nt, Artificial Sequence
  derived and/or modified sequence opt1 from anti-influenza_Chain
gaggugcagcuggucgagagcggccccgcccucgugaagcccacccagacccugacgcugaccugcuccuucagcggguucucccucagcaccuccggcaugagcguguccuggauccgccagccgcccgggaaggcccuggaguggcuggcgcucaucgacugggacgacgacaccuacuacaucacguacagcuccagccugaagacccggcugaccaucuccaaggacaccagcaagucccaggucgugcucacgaugaccaacauggaccccguggacaccgccaccuacuacugcgcccgcacgcugcgggucagcggcgacuacgugcgcgacuucgaccugugggggcggggcacccucgugaccgucucc

SEQ ID NO: 12671 - RNA, 378 nt, Artificial Sequence
  derived and/or modified sequence opt1 from anti-influenza_Chain
caggugcagcugcaggagagcggccccgggcucgucaagccguccgagacccugagccugaccugcacgguguccggcgggagcaucaacuccuacuacuggaacuggauccgccagccgcccggcaaggggcucgaguggaucggcuacaucuaccacagcggcuccaccaacuacaaccccagccugaagucccgggugaccaucagcgucgacaccuccaagaaccaguucagccugcagcucuccagcgugacggccgccgacaccgcgguguacuacugcgcccgccugcggaccgacuacggggaccccgacuccgucuacuacuacggcauggacgugugggggcagggcaccacggugaccgucagcucc

SEQ ID NO: 12672 - RNA, 378 nt, Artificial Sequence
  derived and/or modified sequence opt1 from anti-influenza_Chain
caggugcaccugguccagagcggcgccgaggugcgcaagcccggggacuccgugaaggucagcugcaagaccuccggcuacaccuucagcacguacccgguggccugggugcggcagguccccgggcagggccucgaguggaugggguggaucuccaccuacaacggcaacaccaacuucgcgcagaacuuccagggccgcgugacccugacgaccgacaccaccacgaacaccgccuacauggaggugcggagccugaaguucgacgacaccgccgucuacuacugcgcccgcguggagggguccuaccgggacuucuggaacaaccagaaccgcuucgaccccuggggccaggggacccucgugacggucagcucc

SEQ ID NO: 12673 - RNA, 378 nt, Artificial Sequence
  derived and/or modified sequence opt1 from anti-influenza_Chain
gaggugcagcuggucgagagcggcgccgaggugaagaagcccggggccuccgugaaggucagcugcaaggcguccggcuacaccuucaccagcuucgacaucaacugggugcgccaggccccggggcagggccucgaguggaugggguggaugacgcccaccuccggcaagaccggcuacgcccagaaguuccaggggcggaucaccaugacgcgcaacaccagcaucaacaccgccuacauggagcuguccagccugcgguccgaggacaccgccguguacuucugcgcgcgcggccccgagcggcgcacgaccaucuucgacgucauccucgacugguucgaccccugggggcagggcacccuggugaccgugagc

SEQ ID NO: 12674 - RNA, 378 nt, Artificial Sequence
  derived and/or modified sequence opt1 from anti-influenza_Chain
caggugcagcugguccagagcggcgccgaggugaagaagcccggguccagcgugaaggucuccugcaaggccagcggcggguucuucuccagcuacgccaucuccugggugcgccaggccccgggccaggggcucgaguggaugggcggcgugauccccaucuuccggaccgccaacuacgcccagaacuuccaggggcgcgucaccaucacggccgacgaguucaccagcuacauggagcuguccagccugcgguccgacgacaccgcgguguacuacugcgcccgccucaacuaccacgacagcggcaccuacuacaacgcgccccgggggugguucgaccccuggggccaggggacgcuggugaccgucuccagc

SEQ ID NO: 12675 - RNA, 378 nt, Artificial Sequence
  derived and/or modified sequence opt1 from anti-influenza_Chain
caggugcagcugguccagagcggcgccgaggugaagaagcccggguccagcgugaaggucuccugcaaggccagcggcggggcguucuccaacuacgccaucagcugggugcgccaggccccgggccaggggcucgaguggaugggcggcaucauccccaucuucgggaccaccaacuacgcccagaaguuccagggccgggugacgaucaccgccgacaaguucaccaccaucgcguacauggagcugcgcucccugcggagcgaggacacggccgucuacuacugcgcccgccacgggggcguguacuacuacggguccgccagcuccggcugguucgaccccuggggccaggggacccucgugaccgucagcucc

SEQ ID NO: 12676 - RNA, 378 nt, Artificial Sequence
  derived and/or modified sequence opt1 from anti-influenza_Chain
caggugcagcugcucgagagcggcgggggcgucgugcgccccgggcggucccugcgccuggccugcgccggcagcggguucaccuucuccgcguacgccaugcacugggugcggcaggccccgggcaagggccucgagugggucgcccacaccagcuacgacgggcgcgacuccuacuacguggacagcgugaagggccgguucacgaucucccgcgacgacagcaagaacacccuguaccugcagaugaacucccuccggcccgaggacaccgccgucuacuacugcgcgaagguggggcccuacaccggcuacgacgacuacaacuacuacgggauggacguguggggccacggcacgaccgucaccgugagcucc

SEQ ID NO: 12677 - RNA, 378 nt, Artificial Sequence
  derived and/or modified sequence opt1 from anti-influenza_Chain
caggugcagcuggucgagagcggcgggggcguggugcagcccgggggcucccuccgccugagcugcgccgccuccggguucaacuucgacgaguacgucauguacugggugcggcagagcccgggcaagggccuggagugggugucccucaucggggcggacggccgcgggaccuacaacagcgacuccgucaagggccgguucaccaucagccgcgacaaccggaagaacucccuguaccugcagaugaacagccuccgcuccgacgacacggcccuguacuacugcgccaagguggagcggagcuucuacgacggguccggcuacggcgacgcccuggagaucugggggcagggcaccauggugaccgucagcucc

SEQ ID NO: 12678 - RNA, 381 nt, Artificial Sequence
  derived and/or modified sequence opt1 from anti-influenza_Chain
gaggugcagcugcucgagagcggcgggggccugguccaccccgggggcucccugcgccucagcugcgccgccuccggguucaccuucagcaacuacgcgauguccugggugcggcaggccccgggcaagggccuggagugggugagcuccaucaacagcgggggcggggccaccuacuacgccgacuccgucaagggccgcuucacgaucagccgggacaacuccaagaacacccugagccuccagaugaacucccugcgcgccgaggacaccgcgguguacuacugcgccaaggagggcgggaacaccaucuucggccuggugacgauggccuacuacuucgacagcugggggcagggcacccucgucaccguguccagc

SEQ ID NO: 12679 - RNA, 381 nt, Artificial Sequence
  derived and/or modified sequence opt1 from anti-influenza_Chain
cagccccagcugcaggagagcggcccggggcucgugcgccccuccgagacccugagccugaccugcacggucuccggcgacagcgugacccgcgggggcuucuacuggggguggauccggcagccgcccggcaagggccucgaguggaucggguccaucuacuacaacuacaacaucuaccacagccccucccucaagagccgggugucccugagcgucgacaccuccaagaaccaggugagccugaagcuggccuccgugaccgccgcggacacggccgucuacuacugcgcccgccacuaccccuacuacgaccugcccaccggcuucuacagccaguucgacuucugggggcagggcacccccgugaccguguccagc

SEQ ID NO: 12680 - RNA, 381 nt, Artificial Sequence
  derived and/or modified sequence opt1 from anti-influenza_Chain
ugguggcagcuggugcagagcggcgccgaggucaagaagcccggguccagcgugaagguguccugcaaggccagcggcgggaccuucuccagcuacgacaucuccuggguccgccaggcgccgggccaggggcucgaguggaugggcggcaucauccccaucuacgggaccgccaacuacgcccagaaguuccagggccgggugacgaucaccgccgacgagagcaccuccaccgccuacauggagcugagcucccugcgcagcgaggacacggcgguguacuacugcgcccgggccgggggcgacuccagcggguacuacggcgcccucggccgcuucuuccagcacugggggcagggcacccuggucaccguguccagc

SEQ ID NO: 12681 - RNA, 381 nt, Artificial Sequence
  derived and/or modified sequence opt1 from anti-influenza_Chain
gaggugcagcugguccagagcggcggggccguggugcagcccggccgcucccuccggcugagcugcgccgcguccggguucaccuucagcaucuacgccaugcacuggguccgccagaccccgggcaaggggcuggaguggguggcccucaucuccuacgacggcaacaacaaguacuacgccgacagcgugaagggccgguucacgaucucccgcgacaacuacaagaacacccuguaccugcagaugaaggggcuccgggccgaggacaccgcgcuguacuacugcgcccgccggaucaccgagaagggcuacuacaacgacagcgggcgccccaacugguucgaccccuggggccaggggacgcuggucaccgugucc

SEQ ID NO: 12682 - RNA, 381 nt, Artificial Sequence
  derived and/or modified sequence opt1 from anti-influenza_Chain
caggugcagcugcagcagagcggcccccgccucgucaagccgucccagacccugagccugaccugcgccaucuccggggacagcguguccggcgacagcgggacguggaacuggauccggcagucccccagccgcggccucgaguggcuggggcggaccuacuaccgcuccaagugguacaacgacuacgccgagagcgugaagucccggaucgucaucaaggcggacaccagcaagaacgaguucucccugcagcucaacagcgugacccccgaggacacggccaucuacuacugcgcccgcgccggcgugaagaucuucggccugaucgucggggcccuggacaacuggggccgggggacccucgugaccguguccagc

SEQ ID NO: 12683 - RNA, 381 nt, Artificial Sequence
  derived and/or modified sequence opt1 from anti-influenza_Chain
caggugcagcugcagcaguggggcgccgggcuccugaagcccagcgagacccugucccugaccugcacggucagcggcgggucccucaccgacuacagcuggaacuggauccgccagccgcccggcaaggggcuggaguggaucggcgacacccuccacaacggcuacaccaacuacaaccccucccugcgggggcgcgugagcaucuccaucgacacgagcaagaaccaggugucccugcggcucaccagcgucaccgccgcggacaccgcccuguacuacugcgcccgcggcuccgggggcuacgggggcuucgacuacuucggcaagcugcggacgugggacuucugggggcagggcacccucgugaccgugagcucc

SEQ ID NO: 12684 - RNA, 381 nt, Artificial Sequence
  derived and/or modified sequence opt1 from anti-influenza_Chain
caggugcagcugguccagagcggcgccgaggugcgcaagcccggggagucccuccggaucagcugccgcggcuccggguacaacuucccgaaguacuggaucggcugggugcggcagaugcccgggaagggccuggaguggaugggcaugaucuaccccggggacagcgacguccgcuacaaccccuccuuccagggccaggugaccaucagcgccgacgaguccaucaacaccgcguaccugcaguggagcucccuccggacgagcgacaccgcccgcuacuacugcgcccggcaccuggggcagcagcugguguccaacaccuacuacuacuacggcauggacgucugggggcagggcaccacggugaccgugagcucc

SEQ ID NO: 12685 - RNA, 384 nt, Artificial Sequence
  derived and/or modified sequence opt1 from anti-influenza_Chain
cagauccagcugcaggagagcggccccgggcucgugaagccgucccagacccugagccugaccugcgccaucuccggcgacagcgucuccagcaacaacgccguguggaacuggauccgccagucccccagccgggggcucgaguggcugggccgcacguacuaccgguccaagugguacaacgacuacgcggagagcgugaagucccgcaucaccgucaaccccgacaccagcaagaaccaguucucccugcaccucaagagcgugacccccgaggacacggccguguucuacugcguccgguccgggcacaucaccguguucggcgugaacgucgacgccuucgacauguggggccaggggaccauggugaccgugagcucc

SEQ ID NO: 12686 - RNA, 384 nt, Artificial Sequence
  derived and/or modified sequence opt1 from anti-influenza_Chain
caggugcagcugcaggagagcggccccgggcucgucaagccgucccagacccugagccugaccugcgccaucuccggcgacagcguguccagcaacaacgccguguggaacuggauccgccagucccccagccgggggcucgaguggcugggccgcacguacuaccgguccaagugguacaacgacuacgcggagagcgucaagucccgcaucaccgugaaccccgacaccagcaagaaccaguucucccugcaccucaagagcgugacccccgaggacacggccgucuucuacugcgugcgguccgggcacaucaccguguucggcgucaacguggacgccuucgacauguggggccaggggaccauggugaccgucagcucc

SEQ ID NO: 12687 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgaccgcgugagcuccaacagcgccguguggaacuggauccggcagucccccagccgcgggcucgaguggcugggccggacguacuaccgcuccaagugguacuacgacuacgcggagagcgucaagucccggaucgugaucgaccccgacaccagcaagaaccaggugucccugcagcucaacagcgucacccccgaggacuccgccaucuacuacugcgcccgcgggggccacaucaccguguucggccugaacaucgacgccuacgacaucugggggcagggcgccaaggugacggucagcucc

SEQ ID NO: 12688 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgaccgcgugagcuccaacagcgccguguggaacuggauccggcagucccccagccgcgggcucgaguggcugggccggacguacuaccgcuccaagugguacuacgacuacgcggagagcgucaagucccggaucgugaucgaccccgacaccagcaagaaccaggugucccugcagcucaacagcgucacccccgaggacuccgccaucuacuacugcgcccgcgggggccacaucaccguguucggccugaacaucgacgccuacgacaucugggggcagggcgccauggugacggucagcucc

SEQ ID NO: 12689 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgaccgcgugagcuccaacagcgccguguggaacuggauccggcagucccccagccgcgggcucgaguggcugggccggacguacuaccgcuccaagugguacuacgacuacgcggagagcgucaagucccggaucgugaucgaccccgacaccagcaagaaccaggugucccugcagcucaacagcgucacccccgaggacuccgccaucuacuacugcgcccgcgggggccacaucaccgaguucggccugaacaucgacgccuacgacaucugggggcagggcgccauggugacggugagcucc

SEQ ID NO: 12690 - RNA, 384 nt, Artificial Sequence
  derived and/or modified sequence opt1 from anti-influenza_Chain
caggugcagcugcagcagagcggccccgggcucgucaagccgucccagacccugagccugaccugcgugaucuccggcgacacggugagcuccaaccgcgccaccuggaacuggaugcggcagagcccccuccgcgggcuggaguggcugggccggaccuacuaccgcuccaagugguacaacgacuacgccgucagcgugaagucccggguggucaucaaccccgacaccagcaagaaccaggugucccuccagcugaacacggugacccccgacgacagcggggucuacuucugcgcgcgcggcggccacaucaccguguucggggugaacaucgacgccuucgacaucuggggccuggggaccaaggucacgguguccagc

SEQ ID NO: 12691 - RNA, 384 nt, Artificial Sequence
  derived and/or modified sequence opt1 from anti-influenza_Chain
cagguggagcugcagcagagcggccccgggcucgucaagccgucccagacccugagccugaccugcgccaucuccggcgacagcguguccagcaacuccgccacguggaacuggauccggcagagccccucccgggggcucgaguggcugggccgcaccuacuaccggagcaagugguacaacgacuacgcggacuuccugaagcgccggaucaccaucaaccccgacaccuccaacaacgaggugagccuccgccugacguccgucacccccgacgacaccgcccuguacuacugcgcccgcgggggccacaucaccguguucggcgugaacaucgacgccuucgacgucugggggcagggcacgauggccaccgugagcucc

SEQ ID NO: 12692 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgacagcguguccagcaacuccgccacguggaacuggauccggcagagccccucccgggggcucgaguggcugggccgcaccuacuaccggagcaagugguacaacgacuacgcggacuuccugaagcgccggaucaccaucaaccccgacaccuccaacaacgaggugagccuccgccugacguccgucacccccgacgacaccgcccuguacuacugcgcccgcgggggccacaucaccguguucggcgugaacaucgacgccuucgacgucugggggcagggcacgauggugaccgugagcucc

SEQ ID NO: 12693 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgacagcguguccagcuacaacgccguguggaacuggauccgccagucccccagccgggggcucgaguggcugggccgcacguacuaccgguccgggugguacaacgacuacgcggagagcgucaagucccgcaucaccaucaaccccgacaccagcaagaaccaguucucccugcagcucaacagcgugacccccgaggacacggccguguacuacugcgcccgguccggccacaucaccgucuucggcgugaacguggacgccuucgacaugugggggcagggcaccauggucaccgugagcucc

SEQ ID NO: 12694 - RNA, 384 nt, Artificial Sequence
  derived and/or modified sequence opt1 from anti-influenza_Chain
caggugcagcugcagcagagcggccccgggcucgucaagccgucccagacccugagccugaccugcgccaucuccggcgacagcguguccagcaacaacgccguguggaacuggauccgccagucccccagccgggggcucgaguggcugggccgcacguacuaccgguccaagugguacaacgacuacgcggagagcgucaagucccgcaucaccaucaaccccgacaccagcaagaaccaguucucccugcagcucaacagcgugacccccgaggacacggccguguacuacugcgcccgguccgggcacaucaccgucuucggcgugaacguggacgccuucgacauguggggccaggggaccaccgucacggugagcucc

SEQ ID NO: 12695 - RNA, 384 nt, Artificial Sequence
  derived and/or modified sequence opt1 from anti-influenza_Chain
cgcggccagcuggugcagagcgggggcggggucgugcagcccggccggucccuccgccugagcugcgccgccuccggguucguguucaacgucuucggcauccacugggugcggcaggcgccgggcaaggggcuggaguggcucgccaccaucagcuacgacggccugaacaaguacuacgccgacuccgugaaggggcgcaucaccaucagccgggacaacuccaagaacacgcuguaccuccagaugaacagccugcgcgccgaggacaccgccgucuacuacugcgugcgggacuccgaggagagcaccuacuacggcgacuacauguggguguacaacugguucgaccugugggggcagggcacccucgucacggugucc

SEQ ID NO: 12696 - RNA, 384 nt, Artificial Sequence
  derived and/or modified sequence opt1 from anti-influenza_Chain
caggugcagcugcagcaguggggcagcgggcuccugaagcccuccgagacccugagccugaccugcgccgucuacggcggguccuuccgcgacgacuacuggacguggauccggcagccgcccggcaaggggcuggaguggaucggcgagaucaaccacagcggccgcaccaacuacaaccccucccucaagagccgggugaccaucuccguggacaccagccucaagcaguucucccugaaggucaucagcgugacggccgcggacaccgccguguacuacugcgcccgcgggaccucccacgucagccgguacuucgacuggcugcccccgaccaacugguucgaccccuggggccaggggacccaggugacgguguccagc

SEQ ID NO: 12697 - RNA, 384 nt, Artificial Sequence
  derived and/or modified sequence opt1 from anti-influenza_Chain
caggugcagcugcagcaguggggcgccgggcuccugaagcccagcgagacccugucccucagcugcgccgucuucggcggguccuucagcgacuacuacuggaccuggauccgccagccgcccggcaaggggcuggaguggaucggcgagaucaagcacuccggccggacgaacuacaaccccagccuggagucccgcgugaccaucagcguggacaccuccaagaaccaguucagccucaagcuguccagcgucaccgcggccgacacggccaucuacuacugcgcccgggggaccgaccccgacaccgagggcuacugccgcuccgggagcugcuccgccuucgacuucuggggccaggggacccuggugacggugagcucc

SEQ ID NO: 12698 - RNA, 384 nt, Artificial Sequence
  derived and/or modified sequence opt1 from anti-influenza_Chain
caggugcagcugcagcaguggggcgccgggcuccugaagcccagcgagacccugucccugaccugcggcgucuacgggggcagccucuccgacuacuacuggagcuggauccgccagccgcccgggaagggccuggaguggaucggcgagaucaaccacuccgggggcacgaacuacaaccccagccucaagcggcgcgugaccaucuccguggacaccagcaagaagcaguucucccugaagaugaacagcgucaccgccgcggacacggccguguacuacugcgcccgggggaccgaccccgacaccgagguguacugccgcgccggcaacugcgccgcguucgacuucugggggcagggcacccuggucacgguguccagc

SEQ ID NO: 12699 - RNA, 384 nt, Artificial Sequence
  derived and/or modified sequence opt1 from anti-influenza_Chain
caggugcagcugcaggagagcggccccgggcucgucaagccgucccagacccugagccugaccugcacgguguccggcgacagcaucuccagcguggaccacuacugguccuggauccgccagcaccccgucaaggggcucgaguggaucggcuucauguacuacagcgccuccaccuacuacaaccccagccugaagucccgggugaccaucagcaccgacacguccaagaaccaguucagccugcgccucuccagcgugaccgccgcggacaccgccgucuacuacugcgcccgggggaccugcgccggcgacugcucccugcacuacuacuacuacggccuggacgugugggggcagggccgcacggugaccgucagcucc

SEQ ID NO: 12700 - RNA, 384 nt, Artificial Sequence
  derived and/or modified sequence opt1 from anti-influenza_Chain
gagguggcccuggucgagagcggcgccgaggugaagaagcccggguccagcgugaaggucuccugcaaggcgagcggccacaucuucuccggguacgccaucagcugggugcgccaggccccgggccaggggcucgaguggaugggcggcaucauccccaucuucgggaccaccaacuacgcccagaaguuccagggccgggugacgaucaccgccgaccaguccaccagcaccgcguacauggaccuguccaaccugcgcagcgaggacacggccgucuacuacugcgcccgggugaaggacggguacugcacccucaccuccugccccgugggcugguacuucgaccugugggggcgcggcacccuggucacggugagcucc

SEQ ID NO: 12701 - RNA, 384 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggccacaucuucuccggguacgcgaucagcugggugcgccaggccccgggccaggggcucgaguggaugggcggcaucauccccaucuucgggaccaccaacuacgcccagaaguuccagggccgggugacgaucaccgccgaccaguccaccagcaccgccuacauggaccuguccaaccugcgcagcgaggacacggcggucuacuacugcgcccgggugaaggacggguacugcacccucaccuccugccccgugggcugguacuucgaccugugggggcgcggcacccuggucacggugagcucc

SEQ ID NO: 12702 - RNA, 384 nt, Artificial Sequence
  derived and/or modified sequence opt1 from anti-influenza_Chain
caggugcagcugguccagagcggcgccgaggugcgcaagcccggggccuccgugaaggucagcugcaaggcguccggcuacaccuucacccggcacgggaucagcugggugcgccaggcccccggccaggggcucgaguggaugggcuggaucuccgccuacacgggcgacaccgacuacgcccagaaguuccaggggcgggugaccaugaccacggacaccagcaccaacaccgccuacauggagcugcgcucccugcggagcgacgacgcggccgucuacuacugcgcccgccuccggcugcagggcgaggugguggucccgcccucccagagcaacugguucgaccccugggggcagggcacgcuggugaccguguccagc

SEQ ID NO: 12703 - RNA, 384 nt, Artificial Sequence
  derived and/or modified sequence opt1 from anti-influenza_Chain
caggugcagcuggucgagagcggccccgggcucaugaagccguccgagacccugagccugaccugcacgguguccggcgggagcguguccaacuacuacuggagcuggauccgccagccgcccggcaaggggcucgaguggaucggcuacgucuucuacuccggcagcuccaacuacaaccccagccugaacaaccccucccucaagagccgggugaccaucuccaucgacaccagcaacaaccaguucucccugaagcugagcuccgugaccgccgccgacacggcggucuacuacugcgcccgcgggcgggugaacagcggcuacgacugggggcccaacuucgacuccuggggccagggggcccuggugaccgucagcagc

SEQ ID NO: 12704 - RNA, 384 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaccuucuccuacuacgcgaucagcugggugcgccaggccccgggccaggggcucgaguggaugggcggcaucauccccaucguggggaccgcccacuacacgcagaaguuccagggccgggucaccaucaccgccgacgaguccaccagcacggccuacauggagcuguccagccugcgcuccgaggacaccgcgguguacuucugcgcccgggccgccgacgagagcguggagucccucaccaucaaggcguuccgcaccaacuaccacugggggcagggcacgcuggucaccgugagcucc

SEQ ID NO: 12705 - RNA, 387 nt, Artificial Sequence
  derived and/or modified sequence opt1 from anti-influenza_Chain
gaggugcagcuggucgagagcggcgggggcgccgugcagcccggggagucccucaagcugccgugcgccgcgagcggcuucaccuucuccaacuacgggaugcacugggugcgccaggcccccggcaagggccuggagugggucgccgugaucagcuacgacggguccaacaaguacuacgccgacagcgugaagggccgguucaccaucucccgcgacaacagcaaggacacgcucuaccugcagaugaacucccugcgggccgaggacaccgcccucuucuacugcgcgaaggagcgcccccugcggcugcuccgcuacuucgacuggcugagcgggggcgccaacgacuacugggggcagggcacccuggucaccguguccagc

SEQ ID NO: 12706 - RNA, 387 nt, Artificial Sequence
  derived and/or modified sequence opt1 from anti-influenza_Chain
gaggugcagcuggucgagagcggcgggggcgccgugcagcccggggagucccucaagcugagcugcgccgcguccggcuucaccuucagcaacuacgggaugcacugggugcgccaggccccgggcaagggccuggagugggucgccgugaucuccuacgacgggagcaacaaguacuacgccgacuccgugaagggccgguucaccaucagccgcgacaacuccaaggacacgcucuaccugcagaugaacagccugcgggccgaggacaccgcccucuucuacugcgcgaaggagcgcccccugcggcugcuccgcuacuucgacuggcuguccgggggcgccaacgacuacugggggcagggcacccuggucaccgugagcucc

SEQ ID NO: 12707 - RNA, 387 nt, Artificial Sequence
  derived and/or modified sequence opt1 from anti-influenza_Chain
caggugcagcuggucgagagcggcgggggcguggugcagcccgggcgcucccuccggcugagcugcgccgucuccggcuucaccuucagcuccuacgccaugcacugggugcgccaggcgccggggaagggccuggaguggguggccgucaucagcuacgacggcuccaaccaguacuacgccgacagcgugaaggggcgguucaccaucucccgcgacaacagcaagaacacgcucuaccugcagaugaacucccugcgggccgaggacaccgcccucuacuacugcgcgaaggacccccgccugcggcaccuccuguacuuccccuucaccagcaugaucuacuucgacuacuggggccaggggacccuggugacggucuccagc

SEQ ID NO: 12708 - RNA, 387 nt, Artificial Sequence
  derived and/or modified sequence opt1 from anti-influenza_Chain
caggugcagcugguccagagcggcgggggcguggugcagcccgggcgcucccuccggcugagcugcgucgccuccggcuucaccuucagcaccuacgccaugcacugggugcgccaggcgccggggcggggccuggaguggguggccgucaucuccuacgacgccaacuacaaguacuacgccgacagcgugaagggccgcuucuccaucagccgggacaacucccagaacacgcuccaccuggagaugaacacccugcgcaccgaggacaccgcccucuacuacugcgcgaaggacagccagcugcggucccugcucuacuucgaguggcugagccagggguacuucgagcccuggggccaggggacgcuggugaccgucaccucc

SEQ ID NO: 12709 - RNA, 387 nt, Artificial Sequence
  derived and/or modified sequence opt1 from anti-influenza_Chain
caggugcagcugguccagagcggcgggggcguggugcagcccgggcgcucccuccggcugagcugcgucgccuccggcuucaccuucagcaccuacgccaugcacugggugcgccaggcgccggggcggggccuggaguggguggccgucaucuccuacgacggcaacuacaaguacuacgccgacagcgugaaggggcgcuucuccaucagccgggacaacuccaacagcacgcuccaccuggagaugaacacccugcgcaccgaggacaccgcccucuacuacugcgccaaggacucccagcugcggagccugcucuacuucgaguggcugucccagggcuacuucgaccccugggggcagggcacgcuggugaccgucaccagc

SEQ ID NO: 12710 - RNA, 387 nt, Artificial Sequence
  derived and/or modified sequence opt1 from anti-influenza_Chain
caggugcagcugguccagagcggcgccgaggugaagaagcccggguccagcgugaccgucuccugcaaggccagcggcgggaccuucuccaacuacggcaucagcugggugcgccaggcgccggggcagggccucgacuggaugggcgggaucaucccccuguucggcacggccaacuacgcccagaaguuccaggggcgggugaccaucaccgccgacgaguccaccagcuccagcaacauggagcuguccagccuccgcuccgaggacacggccgucuacuacugcgcgcgggacgugcacaacuacgacuuccugaccggcuacccccugcaccucuacgggauggacguguggggccagggcaccaccgucacggugagcucc

SEQ ID NO: 12711 - RNA, 387 nt, Artificial Sequence
  derived and/or modified sequence opt1 from anti-influenza_Chain
caggugcagcugcaggagagcggccccgggcucgucaagccguccgagacccugagccugaucugcgccguguccggcgccagcaucuccagcuccuacuggagcuggauccgccagccgcccgggaagggccucgaguggaucggguacaucuacuacuccggcgugaccaaguacaaccccagccugaagucccgggucacgcugagcguggacaccuccaagaaccacuucagccucaagcuguccuacgugaccgcggccgacaccgccgucuacuacugcgcccgcaaccugcccgacaucgccguggugacggcgguccaggacgccacccccgugugguucgaccccuggggccccgggacccucgugagcgucuccagc

SEQ ID NO: 12712 - RNA, 387 nt, Artificial Sequence
  derived and/or modified sequence opt1 from anti-influenza_Chain
gaggugcagcuggucgagagcggcgggggccucgugcagcccgggcgcucccugcggcugagcugcgccgccuccggcuucaccuucagcgacuucuggauguccugggugcgccaggcgccggggaagggccucgagugggucgccaacaucgaccaggacggcaacgagcgguucuacgccgacagcgugaaggggcgcuucaccaucucccgggacaacgccaagaacagccuguaccugcagaugacgucccuccgcgccgacgacaccgcgguguacuacugcgcccgggacggccgcgagggguacuucuacggcagcggguccuucuacaaccugaagggccugaacuggggccaggggacccuccugaccgucagcucc

SEQ ID NO: 12713 - RNA, 387 nt, Artificial Sequence
  derived and/or modified sequence opt1 from anti-influenza_Chain
gaggugcugauggucgagagcggcgggggccucgugcagcccgggggcuccgugcgccugagcugcgucgccuccggguucagcuucuccagccacuggaugaccugggugcggcaggccccgggcaagggccuggaguggguggcgaacaucgaggacgacgggggcgacaaguacuacgucgacuccgugaaggggcgcuucaucaucagccgggacaacgccaagaacuccguguaccuccagaugaacagccugcgcgccgaggacaccgccgucuacuucugcgcccggggcuccgggagcuccgaccgcagcgacuacgacccccacuacuacuacuaccuggacguguggggcaagggcgcgacggugaccgucuccagc

SEQ ID NO: 12714 - RNA, 387 nt, Artificial Sequence
  derived and/or modified sequence opt1 from anti-influenza_Chain
gaggugcagcuggucgagagcggcggggaccucgugcagcccggccgcucccugaagcugagcugcaccggguccggcuucaccuucggggacuacggcgugacguggguccggcaggcccccggcaaggggcucgagugggugggcuucauccgcacccggcccuggggcgggaccgccgacaccgcggccagcgugaaggggcgcuucacgaucucccgggacgacagcaagucccuggccuaccugcagaugaacagccucaagaccgaggacaccgccgucuacuacugcugccgcgacgccccgcccaacguggagguggcguccaugaccaacugguacuucgaccuguggggccggggcacgcuggucaccgugagcucc

SEQ ID NO: 12715 - RNA, 387 nt, Artificial Sequence
  derived and/or modified sequence opt1 from anti-influenza_Chain
gaggugcagcugguccagagcggcuccgaggugaagaagcccggggagagccucaagaucuccugcaagggcagcggguacuccuucagcaacuacuggaucggcugggugcggcacaugccggggaagggccuggaguggaugggcaucaucuaccccggggacuccgacacccgguacagccccuccuuccagggccaggucaccaugagcgccgacaaguccagcuccacgguguaccugcaguggagcucccucaaggccagcgacaccgcgaucuacuacugcgcccgccgcgggggccacuccuucggguacggcagcggcggggacacccacuccgaguucgacagcuggggccaggggacccuggugacggucagcucc

SEQ ID NO: 12716 - RNA, 387 nt, Artificial Sequence
  derived and/or modified sequence opt1 from anti-influenza_Chain
caggugcagcugcucgagaccggcgggggccuggucaagcccgggcagagccugaagcucuccugcgccgccagcggcuucaccuucacguccuacgcgaugcacugggugcgccagccgcccgggaagggccuggaguggguggccgucgugagcuacgacggcaacuacaaguacuacgccgacuccgugcaggggcgguucaccaucagccgcgacaacuccaagaacacccuguaccuccagaugaacagccugcgggccgaggacaccgccgucuacuacugcgcgaaggacucccgccugcggagccuccuguacuucgaguggcugucccagggcuacuucaaccccugggggcagggcacgacccucaccgugagcucc

SEQ ID NO: 12717 - RNA, 387 nt, Artificial Sequence
  derived and/or modified sequence opt1 from anti-influenza_Chain
caggugcagcuggucgagagcggcgccgaggugaagaagcccggggccuccgugaagcucagcugcaccgcguccggcuacaacuucgccgccuacuacauccacuggguccgccaggccccggggcagggccuggaguggaugggguggagcaaccccaacaccggcggcgccaacuacgcgcaggacuuccaggggcgggugacgaugaccgccgugaccuccaccagcacggccuacauggagcugucccgccucaccagcgacgacaccgcccuguacuucugcgcgcgggucccccgcgaccggcugcucacccuguacuacgaguccagcacguacggcuucgacuacugggggcagggcacccuggugaccguguccagc

SEQ ID NO: 12718 - RNA, 387 nt, Artificial Sequence
  derived and/or modified sequence opt1 from anti-influenza_Chain
caggugcagcuggucgagagcggcgggggccucgugcagcccgggggcucccugcgccugagcugcaccguguccggguucaccuucaacagcuacgccaugaacuggguccggcaggccccgggcaagggccucgaguggguguccgggauccgcggcagcggggagaacacguacuacgcggagaccgugaagggccgguucaccaucucccgcgacaacagcaagaacacccuguaccuggagaugaacucccuccgggccgaggacacggccgucuacuacugcgcccgcaagugggggcggaugaccguguucggcguggccaccgaccagcuguacuacuucgacuacuggggccaggggacccuggucacggugagcucc

SEQ ID NO: 12719 - RNA, 387 nt, Artificial Sequence
  derived and/or modified sequence opt1 from anti-influenza_Chain
caggugcagcuggucgagagcggccccgggcucgugaagccgucccagacccugagccugaccugcacgguguccggcgggagcaucuccaacggcggguaccacuggagcuggauccgccagcaccccggcaagggccucgaguggaucgggaacaucuacuaccggggcuccaccuucuacgaccccagccugaagucccgcgucaccaucagcguggacaccuccaagagccaguucucccugaagcucacgagcgugaccgccgccgacaccgcggucuacuacugcgcccggaugccccuggccaacuacgaccugcucaccgggcuguacaucggcgccuucgaccugugggggcagggcacgauggugaccguguccagc

SEQ ID NO: 12720 - RNA, 387 nt, Artificial Sequence
  derived and/or modified sequence opt1 from anti-influenza_Chain
caggugcagcuggucgagagcggcgccgaggugaagaagcccggggccuccgugcgcgucagcugcaagggcuccggguacaccuucaccgcguaccacaugcacugggugcggcaggccccgggccagggguucgagugggugggcuggaucaaccccaacagcggcgccacguacuacaccuccaccuucgaggggcgcgucaccaugacgcgggacaccagcaucaccaccgccuacauggagcucuccagccugcgcuccgacgacacggccguguacuacugcgcgaccgacaucguggucgagcgggacgccagccugggcggguucaacuccuacggcauggacgugugggggcagggcaccaccgugacggucagcucc

SEQ ID NO: 12721 - RNA, 390 nt, Artificial Sequence
  derived and/or modified sequence opt1 from anti-influenza_Chain
caggugcagcugcagcaguggggcgccgggcuccugaagcccagcgagacccugucccugaccugcgccgucuacggcgggagcuucuccgugagcggcuacuacugguccuggauccgccagccgcccgggcggggccucgaguggaucggcgagaucagccacgggggcuccacgaacuacaaccccagccugaagucccgcgugaccaucagcgucgacaccaccaagaaccaguucucccuccggcugagcuccgugacggcggccgacaccgccguguacuacugcgcccgcgggaccgaccccgacaccgaggucuacugccgggugggcaacugcgccgcguucgacuacugggggcagggcagccuggugacggucuccagc

SEQ ID NO: 12722 - RNA, 390 nt, Artificial Sequence
  derived and/or modified sequence opt1 from anti-influenza_Chain
caggugcagcugcucgagagcggccccgggcuggucaagccgucccagacccugcuccugaccugcacggugagcggcgccuccaucagcaccgggggcaacuacugguccuggauccgccagcaccccgggaaggaccuggaguggaucggcuacaucuucuacagcggcaccaccaaguacaaccccuccguggacaaccccagccucaagucccgggucacgaugagcguggacaccuccgagaaccaguucagccugaagcuguccagcgugaccgccgcggacaccgccgucuacuucugcgcccgcggguccccgaacagcggcuacgacugggggccccacuucgacuacuggggccaggggacgcucgugaccguguccagc

SEQ ID NO: 12723 - RNA, 390 nt, Artificial Sequence
  derived and/or modified sequence opt1 from anti-influenza_Chain
gaggugcagcuggucgagagcggcgggcaccucgugcagcccggccgcucccugcggcugagcugcgccgccuccggguucaccuucgaggacuacgcgaugaacugggugcgccaggccccgggcaaggggcucgagugggucagcgugaucuccugggacagcggccggaucggcuacgccgacuccgugaaggggcgcuucaccaucagccgggacaacgccaagaacuccagcuaccugcagaugaacucccugcgccccgaggacacggcccucuacuacugcguccgggacaugcuggcguacuacagcgacaacuccggcaagaaguacaacguguacgggauggacguguggggccaggggaccaccgucaccgugagcucc

SEQ ID NO: 12724 - RNA, 390 nt, Artificial Sequence
  derived and/or modified sequence opt1 from anti-influenza_Chain
gaggugcagcuggucgagagcggcgggggccucgugcagcccgggcgcucccugcggcugagcugcgccguguccggcuucaucuucgaggacuacgccaucaacuggguccgccaggcgccggggaagggccucgagugggugagcaucaucuccugggacagcggccggaucggguacgccgacuccgugcgcggccgguucaccaucagccgcgacaacgccaagaacuccagcuuccugcagaugaacucccugcggcccgaggacaccgccgucuacuacugcgugaaggacaugcucgccuacuacuacgacgggagcggcauccgcuacaaccuguacgggauggacguguggggccagggcacgaccgucaccguguccagc

SEQ ID NO: 12725 - RNA, 390 nt, Artificial Sequence
  derived and/or modified sequence opt1 from anti-influenza_Chain
gaggugcagcuggucgagagcggcgggggccucgugcagcccgggcgcucccugcggcugagcugcgccguguccggcuucaucuucgaggacuacgccaucaacuggguccgccaggcgccggggaagugccucgagugggugagcaucaucuccugggacagcggccggaucggcuacgccgacuccgugcgcgggcgguucaccaucagccgcgacaacgccaagaacuccagcuuccugcagaugaacucccugcggcccgaggacaccgccgucuacuacugcgugaaggacaugcucgccuacuacuacgacggcagcgggauccgcuacaaccuguacggcauggacgugugggggcagggcacgaccgucaccguguccagc

SEQ ID NO: 12726 - RNA, 396 nt, Artificial Sequence
  derived and/or modified sequence opt1 from anti-influenza_Chain
cagaucacccugaaggagagcggccccacccucgugaagccgacgcagacccugacccugaccugcgucuucuccggguucagccucuccaucacgggcgugcgcgugggguggauccggcagccgcccggcaaggcccuggaguggcuggcccucaucagcugggacgacgagaagcacuacucccccagccugcagucccgccugaccaucaccaaggacaccagcaagaaccaggucgugcucacgaugaccaaccuggaccccguggacaccgcgaccuacuacugcgcccgguccacggaccgcgggcacguccugcgguacuucggcuggaugcuccccggcgacgccuucgacgugugggggcagggcaccauggugaccgucagcucc

SEQ ID NO: 12727 - RNA, 396 nt, Artificial Sequence
  derived and/or modified sequence opt1 from anti-influenza_Chain
caggugcagcugcaggagagcggccccgggcucgucaagccguccgagacccugagccugaccugcacgguguccagcggccccauguccgacuacuacuggagcuggauccgccagccgcccgggaagggccucgaguggaucgggcacguguccgucagccacggcggccggaccaaguccaaccccagcgugaugucccgcgugaccaucagcgucgagaccuccaagaaccaguucagccugaagcugacguccgugaccgccgccgacaccgcgguguacuacugcgcccggcucaacuacuacgaccgcagcggguaccacucccccgacggccccagcaacaacugguucgaccccugggggcagggcacccuggucacgguguccagc

SEQ ID NO: 12728 - RNA, 396 nt, Artificial Sequence
  derived and/or modified sequence opt1 from anti-influenza_Chain
caggugcagcugguccagagcggcgccgaggugaagaagcccggggccuccgugaaggucagcugcaagaccuccggcuacaccuucacggcguacaccauccacugggugcgccaggccccggggcagcggcucgaguggaugggcuggaucaacgccgggaacggccacaccaaguacagccagcgcuucaagggccgggugaccaucacgcgcgacaccuccgcccggaccaccuacauggagcugcgcagccugacguccgaggacaccgcccucuacuucugcgcgcgggggcccgagaccuacuacuacgacaagaccaacuggcugaacagccaccccgacgaguacuuccagcacuggggccacgggacgcaggucaccguguccagc

SEQ ID NO: 12729 - RNA, 399 nt, Artificial Sequence
  derived and/or modified sequence opt1 from anti-influenza_Chain
caggugcagcugguccagagcggcuccgaggugaagaagcccggggccagcgugaaggucuccugcaaggccagcggcuacaccuucaccaacuacgacaucaacuggauccgccaggcgccggggcagggccucgaguggaugggguggaucaaccccaacuccggcacgaccggcagcgcccagcgguuccaggggcgcgugaccaucaccguggacacguccaucaccaccgucuacauggagcugagcucccugcggagcgacgacaccgccaucuacuacugcgcccgcggccgggagcuccugcgccugcagcacuuccucacggacucccagagcgagcggcgcgacugcuucgaccccugggggcagggcacccuggugaccguguccagc

SEQ ID NO: 12730 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccgggcucagcuuccugaacgcguggauguccugggugcggcaggccccgggcaagggccuggagugggucgggcgcaucaagagcaacaccgacggcgggaccacggacuacgccgcccccgugaagggccgguucaccaucucccgcgacgacagcaagaacacccucuaccugcagauguccagccugaagaccgaggacacggccguguacuacugcaccaccgacgggcccuacuccgacgacuuccggagcggcuacgcggcccgcuaccgguacuucggcauggacgucugggggcagggcaccacggugaccguguccagc

SEQ ID NO: 12731 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucagcuuccucaacgcguggauguccugggugcggcaggccccgggcaagggccuggagugggucgggcgcaucaagagcaacaccgacggcgggaccacggacuacgccgcccccgugaagggccgguucaccaucucccgcgacgacagcaagaacacccuguaccuccagauguccagccugaagaccgaggacacggccguguacuacugcaccaccgacgggcccuacuccgacgacuuccggagcggcuacgcggcccgcuaccgguacuucggcauggacgucugggggcagggcaccacggugaccguguccagc

SEQ ID NO: 12732 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccgggcucaccuuccugaacgcguggaugagcugggugcggcaggccccgggcaagggccuggagugggucgggcgcaucaaguccaacaccgacggcgggacgaccgacuacgccgcccccgugaagggccgguucaccaucagccgcgacgacuccaagaacacccucuaccugcagaugagcucccugaagacggaggacaccgccguguacuacugcaccaccgacgggcccuacagcgacgacuuccgguccggcuacgcggcccgcuaccgguacuucggcauggacgucugggggcagggcacgaccgugaccgugagcucc

SEQ ID NO: 12733 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucagcuucuccaacgcguggaugagcugggugcggcaggccccgggcaagggccucgagugggucgggcgcaucaaguccaacaccgacggcgggaccacggacuacgccgcccccgugaagggccgguucaccaucagccgcgacgacuccaagaacacccuguaccugcagaugagcucccucaagaccgaggacacggccguguacuacugcaccaccgacgggcccuacagcgacgacuuccgguccggcuacgcggcccgcuaccgguacuucggcauggacgucugggggcagggcaccacggugaccgugagcucc

SEQ ID NO: 12734 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccgggcucaccuucagcaacgcguggauguccugggugcggcaggccccgggcaagggccuggagugggucgggcgcaucaagagcaacaccgacggcgggacgaccgacuacgccgcccccgugaagggccgguucaccaucucccgcgacgacagcaagaacacccuguaccuccagauguccagccugaagacggaggacaccgccguguacuacugcaccaccgacgggcccuacuccgacgacuuccggagcggcuacgcggcccgcuaccgguacuucggcauggacgucugggggcagggcacgaccgugaccguguccagc

SEQ ID NO: 12735 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucaccuucagcaacgcguggauguccugggugcggcaggccccgggcaagggccucgagugggucgggcgcaucaagagcaacaccgacggcgggacgaccgacuacgccgcccccgugaagggccgguucaccaucucccgcgacgacagcaagaacacccuguaccugcagauguccagccucaagacggaggacaccgccguguacuacugcaccaccgacgggcccuacuccgacgacuuccggagcggcuacgcggcccgcuaccgguacuucggcauggacgucugggggcagggcacgaccgugaccguguccagc

SEQ ID NO: 12736 - RNA, 402 nt, Artificial Sequence
  derived and/or modified sequence opt1 from anti-influenza_Chain
gaggugcagcuggucgugagcggcgggggccucgugaagcccgggggcucccugcgccugagcugcgccgccuccgggcucagcuuccugaacgcguggauguccuggguccggcaggccccgggcaagggccuggaguggguggggcgcaucaagagcaacaccgacggcgggaccacggacuacgccgcccccgugaagggccgguucuccaucagccgcgacgacuccaagaacaugcuguuccuccacaugagcucccugcggaccgaggacaccgccgucuacuacugcgcgaccgacgggcccuacagcgacgacuuccgcuccggcuacgccgcccgguaccgcuacuucggcauggacgugugggggcagggcacgaccgugaccgucagcucc

SEQ ID NO: 12737 - RNA, 402 nt, Artificial Sequence
  derived and/or modified sequence opt1 from anti-influenza_Chain
gaggugcagcuggucgugagcggcgggggccucgugaagcccgggggcucccugcgccugagcugcgccgccuccgggcucagcuuccugaacgcguggauguccuggguccggcaggccccgggcaagugccuggagugggugggccgcaucaagagcaacaccgacgggggcaccacggacuacgccgcccccgugaaggggcgguucuccaucagccgcgacgacuccaagaacaugcuguuccuccacaugagcucccugcggaccgaggacaccgccgucuacuacugcgcgaccgacggccccuacagcgacgacuuccgcuccggguacgccgcccgguaccgcuacuucggcauggacguguggggccaggggacgaccgugaccgucagcucc

SEQ ID NO: 12738 - RNA, 402 nt, Artificial Sequence
  derived and/or modified sequence opt1 from anti-influenza_Chain
gaggugcagcuggucgugagcggcgggggccucgugaagcccgggggcucccugcgccugagcugcgccgccuccgggcucagcuuccugaacgcguggauguccuggguccggcaggccccgggcaagggccuggaguggguggggcgcaucaagagcaacaccgacggcgggaccacggacuacgccgcccccgugaagggccgguucuccaucagccgcgacgacuccaagaacaugcuguuccuccacaugagcucccugcggaccgaggacaccgccgucuacuacugcgcgaccgacgggcccuacagcgacgacuuccgcuccggcuacgccgcccgguaccgcuacuucggcauggacgugugggggugcggcacgaccgugaccgucagcucc

SEQ ID NO: 12739 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucaccuuccucaacgcguggaugagcugggugcggcaggccccgggcaagggccuggagugggucgggcgcaucaaguccaacaccgacggcgggacgaccgacuacgccgcccccgugaagggccgguucaccaucagccgcgacgacuccaagaacacccuguaccuccagaugagcucccugaagacggaggacaccgccguguacuacugcaccaccgacgggcccuacagcgacgacuuccgguccggcuacgcggcccgcuaccgguacuucggcauggacgucugggggcagggcacgaccgugaccgugagcucc

SEQ ID NO: 12740 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucaccuuccucaacgcguggaugagcugggugcggcaggccccgggcaagugccuggagugggucggccgcaucaaguccaacaccgacgggggcacgaccgacuacgccgcccccgugaaggggcgguucaccaucagccgcgacgacuccaagaacacccuguaccuccagaugagcucccugaagacggaggacaccgccguguacuacugcaccaccgacggccccuacagcgacgacuuccgguccggguacgcggcccgcuaccgguacuucggcauggacgucuggggccaggggacgaccgugaccgugagcucc

SEQ ID NO: 12741 - RNA, 402 nt, Artificial Sequence
  derived and/or modified sequence opt1 from anti-influenza_Chain
gaggugcagcuggucgagagcggcgggggccucgugaagcccgggggcucccugcgccugagcugcgccgccuccggguucaccuuccucaacgcguggaugagcugggugcggcaggccccgggcaagggccuggagugggucgggcgcaucaaguccaacaccgacggcgggacgaccgacuacgccgcccccgugaagggccgguucaccaucagccgcgacgacuccaagaacacccuguaccuccagaugagcucccugaagacggaggacaccgccguguacuacugcaccaccgacgggcccuacagcgacgacuuccgguccggcuacgcggcccgcuaccgguacuucggcauggacgucugggggugcggcacgaccgugaccgugagcucc

SEQ ID NO: 12742 - RNA, 414 nt, Artificial Sequence
  derived and/or modified sequence opt1 from anti-influenza_Chain
caggugcagcugcaggagagcggcgggggccucguccagcccggggagucccugcgccugagcugcgugggcuccgggagcuccuucggcgagagcacccucuccuacuacgccgugagcuggguccggcaggccccgggcaaggggcuggaguggcuguccaucaucaacgcgggcgggggcgacaucgacuacgccgacagcguggaggggcgcuucaccaucucccgggacaacagcaaggagacgcucuaccugcagaugaccaaccugcgcguggaggacaccggcgucuacuacugcgccaagcacauguccaugcagcaggucgugagcgccggcugggagcgggccgaccucgugggggacgcguucgacguguggggccaggggaccauggugacggucuccagc

SEQ ID NO: 12743 - RNA, 465 nt, Artificial Sequence
  derived and/or modified sequence opt1 from anti-influenza_Chain
cugagccgcaucaaccacuucgagaagauccagaucauccccaaguccagcugguccgaccacgaggccagcuccggcgugagcuccgccugcccguaccaggggacccccagcuucuuccggaacgucguguggcucaucaagaagaacaacaccuaccccacgaucaagcgcuccuacaacaacaccaaccaggaggaccugcugauccucuggggcauccaccacagcaacgacgcggccgagcagaccaagcuguaccagaaccccaccacguacaucuccguggggaccagcacccugaaccagcggcucgucccgaagaucgccacccgcuccaaggugaacggccagaacgggcggauggacuucuucuggacgauccugaagcccaacgacgccaucaacuucgagagcaacggcaacuucaucgcccccgaguacgcguacaagaucgugaagaag

SEQ ID NO: 12744 - RNA, 564 nt, Artificial Sequence
  derived and/or modified sequence opt1 from anti-influenza_Chain
aacgugcccgaguggagcuacaucgucgagaaggccaacccggccaacgaccugugcuaccccggcaacuucaacgacuacgaggagcucaagcaccuccugucccgcaucaaccacuucgagaagauccagaucauccccaagagcuccuggagcgaccacgaggcguccagcgggguguccagcgccugccccuaccagggcaccccguccuucuuccggaacguggucuggcugaucaagaagaacaacaccuaccccacgaucaagcgcagcuacaacaacaccaaccaggaggaccugcugauccucugggggauccaccacuccaacgacgccgccgagcagaccaagcuguaccagaaccccaccacguacaucagcgugggcaccuccacccugaaccagcggcucgugcccaagaucgccacccgcagcaaggucaacgggcagaacggccggauggacuucuucuggacgauccugaagccgaacgacgcgaucaacuucgaguccaacggcaacuucaucgcccccgaguacgccuacaagaucgugaagaag

SEQ ID NO: 12745 - RNA, 609 nt, Artificial Sequence
  derived and/or modified sequence opt1 from anti-influenza_Chain
augcugcgcagccucgugcugaacgagaagcugcgggcccgcguccucgagcgggccgaggaguuccugcugaacaacaaggcggacgaggaggugugguuccgcgagcucgugcugugcauccugaccuccaacagcuccuucaucagcgccuacaaguccaugaacuacauccucgacaagauccuguacauggacgagaaggagaucagcauccugcuccaggaguccggcuaccgguucuacaaccugaaggccaaguaccuguaccgcgccaagaaccucuacgggaaggucaagaagaccaucaaggagaucgccgacaaggaccagaugcaggcgcgggaguucaucgccacgcacaucuacggcaucggguacaaggaggccagccacuuccugcgcaacgugggcuaccuggaccucgccaucaucgaccggcacauccugcgcuucaucaacaaccuggggauccccaucaagcucaaguccaagcgggaguaccugcuggcggagagccuccugcgcuccaucgccaacaaccugaacgugcaggucggccuccuggaccuguucaucuucuucaagcagaccaacaccaucgugaag

SEQ ID NO: 12746 - RNA, 615 nt, Artificial Sequence
  derived and/or modified sequence opt1 from anti-influenza_Chain
ggccuguucggggccaucgccggcuucaucgagggcggguggaccgggaugguggacggcugguacggcuaccaccaccagaacgagcaggggagcggcuacgcggccgaccucaaguccacccagaacgccaucgacgagaucacgaacaaggucaacagcgugaucgagaagaugaacacccaguucaccgccguggggaaggaguucaaccaccuggagaagcgcaucgagaaccugaacaagaagaucgacgacggcuuccucgacaucuggaccuacaacgccgagcugcugguccuccuggagaacgagcggacgcuggacuaccacgacuccaacgugaagaaccucuacgagaaggugcgcagccagcugaagaacaacgcgaaggagaucgggaacggcugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggccaucuacagcaccguggccuccagccugguccucguggugucccugggcgcg

SEQ ID NO: 12747 - RNA, 639 nt, Artificial Sequence
  derived and/or modified sequence opt1 from anti-influenza_Chain
gagaucgugcugacccagagccccggcacccucucccugagcccgggggagcgcgccacgcuguccugccgggccagccagcgcgucuccagcuaccucgcgugguaccagcagaagcccggccaggcgccccggcugcugaucuacggggccuccacccgcgccgccggcauccccgaccgguucagcggguccggcagcggcaccgacuucacccucacgaucucccgccuggagccggaggacagcgccguguacuacugccagcaguacgggcggacgccccugaccuucggcgggggcaccaagguggagaucaagcgcgccgccgcccccuccgucuucaucuucccgcccagcgacgagcagcucaaguccgggaccgcgagcguggugugccugcugaacaacuucuacccccgggaggccaagguccaguggaagguggacaacgcccuccaguccggcaacagccaggaguccgugaccgagcaggacagcaaggacagcaccuacucccugagcuccacccugacgcucagcaaggccgacuacgagaagcacaaggucuacgccugcgaggugacccaccagggccuguccagccccgugaccaaguccuucaaccgcggggagugc

SEQ ID NO: 12748 - RNA, 639 nt, Artificial Sequence
  derived and/or modified sequence opt1 from anti-influenza_Chain
gacauccagaugacccagagccccuccagccuguccgccagccucggcgggaacgugaccaucacgugcaaggccucccaggacaucaacaaguacaucgcgugguaccagcacaagccgggcaaggggccccgccuggucauccacuacaccagcacccugcagcccggcauccccucccgguucagcggguccggcagcggcaccgacuacuccuucagcaucuccaaccucgagccggaggacaucgccacguacuacugccugcaguacgacauccuguacaccuucgggggcgggaccaagcucgagaucaagcgcgccgacgccgcccccaccgugagcaucuucccgcccuccagcgagcagcugacguccggcggggcgagcguggucugcuuccugaacaacuucuaccccaaggacaucaacgugaaguggaagaucgacggcuccgagcggcagaacggcgugcucaacagcuggaccgaccaggacagcaaggacuccaccuacagcauguccagcacccugacgcugaccaaggacgaguacgagcgccacaacuccuacacgugcgaggccacccacaagaccagcaccucccccaucgucaagagcuucaaccggaacgagugc

SEQ ID NO: 12749 - RNA, 642 nt, Artificial Sequence
  derived and/or modified sequence opt1 from anti-influenza_Chain
gacauccagaugacccagagccccuccagccuguccgccagcgugggcgaccgcgucaccaucacgugccgggccucccaggggaucagcuccuaccucgcgugguaccagcagaagccgggcaaggugcccacccugcugaucuacgacgccagcacccuccgcuccggggugcccagccgguucuccggcagcggguccgccaccgacuucacgcugaccaucagcucccugcagcccgaggacgucgccaccuacuacugccagcgcuacaacagcgccccgcccaucaccuucggccagggcacgcggcucgagaucaagcgcgcggccgcccccuccguguucaucuucccgcccagcgacgagcagcugaaguccgggaccgccagcguggucugccugcucaacaacuucuacccccgggaggcgaaggugcaguggaagguggacaacgcccugcagagcggcaacucccaggagagcgucaccgagcaggacuccaaggacagcaccuacucccugagcuccacgcucacccugagcaaggccgacuacgagaagcacaagguguacgccugcgaggugacccaccaggggcuguccagccccgucaccaaguccuucaaccgcggcgagugc

SEQ ID NO: 12750 - RNA, 642 nt, Artificial Sequence
  derived and/or modified sequence opt1 from anti-influenza_Chain
gagaucgugcugacccagagccccggcacccucucccugagcccgggggagcgggccacgcuguccugccgggccagccaguccgucagcuccagcuaccucgcgugguaccagcagaagcccggccaggcgccccgccugcugaucuacggggccuccagccgggccaccggcauccccgaccgcuucuccgggagcggcuccggcaccgacuucacccucacgaucagccggcuggagccggaggacuucgccguguacuacugccagcaguacggguccagcccccgcaccuucggcgggggcaccaagguggagaucaagcgggccgccgcccccuccgucuucaucuucccgcccagcgacgagcagcugaaguccgggaccgccagcguggugugccuccugaacaacuucuacccccgcgaggcgaagguccaguggaagguggacaacgcccugcagagcggcaacucccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgcggggagugc

SEQ ID NO: 12751 - RNA, 642 nt, Artificial Sequence
  derived and/or modified sequence opt1 from anti-influenza_Chain
agcuacgugcugacccagcccccguccgucagcguggcccccggcgagaccgccacggugaccugcgggggcaacaacaucggguccaagagcguccacugguaccagcagaagcccggccaggcgcccgugguggucaucuacuacgacggggaccgcccguccggcauccccgagcgguucagcggcuccaacagcggggacaccgccacccucacgaucucccgcguggaggccggcgacgaggccgacuacuacugccuggugugggacuacaccagcguccacuacguguucgggaccggcaccaaggugacgguccuggggcagcccaaggccaaccccaccgugacccucuucccgcccuccagcgaggagcugcaggcgaacaaggccacccuggugugccucaucuccgacuucuaccccggcgccgucacgguggccuggaaggcggacggcagccccgugaaggccggggucgagaccaccaagccguccaagcagagcaacaacaaguacgccgccuccagcuaccugucccugacccccgagcaguggaagucccaccggagcuacagcugccaggugacgcacgagggcagcaccguggagaagaccgucgcccccaccgagugcucc

SEQ ID NO: 12752 - RNA, 642 nt, Artificial Sequence
  derived and/or modified sequence opt1 from anti-influenza_Chain
gacauccagaugacccagaccagcuccagccuguccgccagccucggcgaccgcgugacgaucuccugccgggccagccaggacauccgcaacuaccugaacugguaccagcagaagcccgacgggaccgucaagcugcucaucuacuacaccucccggcugcacagcggcgugccgucccgcuucagcgacuccgggagcggcaccgacuacucccugacgaucagcaaccucgagcaggaggaccuggcgaccuacuucugccagcagaccuacacccugcccuggacguucgggggcggcaccaagcucgagaucaagcgggccgacgccgcccccaccguguccaucuucccgcccagcuccgagcagcugaccagcgggggcgccuccgucgugugcuuccugaacaacuucuaccccaaggacaucaacgugaaguggaagaucgacgggagcgagcgccagaacggcguccucaacagcuggacggaccaggacuccaaggacagcaccuacuccaugagcuccacccugacccugacgaaggacgaguacgagcggcacaacagcuacacgugcgaggcgacccacaagaccuccaccagccccaucgugaaguccuucaaccgcaacgagugc

SEQ ID NO: 12753 - RNA, 645 nt, Artificial Sequence
  derived and/or modified sequence opt1 from anti-influenza_Chain
gacggcgugaagccccugauccuccgcgacugcagcgucgccggguggcugcugggcaacccgaugugcgacgaguucaucaacgugcccgagugguccuacaucguggagaaggccaaccccgcgaacgaccucugcuaccccgggaacuucaacgacuacgaggagcugaagcaccuccugagccggaucaaccacuucgagaagauccagaucaucccgaaguccagcugguccgaccacgaggccagcuccggcgucagcuccgccugccccuaccaggggacccccagcuucuuccgcaacgugguguggcugaucaagaagaacaacaccuaccccacgaucaagcgguccuacaacaacaccaaccaggaggaccugcucauccuguggggcauccaccacagcaacgacgccgccgagcagaccaagcuguaccagaacccgaccacguacaucuccgucggcaccagcacccucaaccagcgccuggugcccaagaucgcgacccgguccaaggugaacgggcagaacggccgcauggacuucuucuggacgauccugaagcccaacgacgccaucaacuucgagagcaacgggaacuucaucgcccccgaguacgccuacaagaucgucaagaag

SEQ ID NO: 12754 - RNA, 645 nt, Artificial Sequence
  derived and/or modified sequence opt1 from anti-influenza_Chain
gacauccagaugacccagagccccuccacccugagcgccuccgugggcgaccgggucacgaucacgugccgggccagccagaccaucaacaacuaccucgcgugguaccagcagaagccggggaaggcccccaagcugcugaucuacaaggccuccagccucgaguccggcgugcccagccgcuucuccgggagcggcuccgggaccgaguucacccugaccaucagcucccugcagcccgacgacuucgccaccuacuacugccaggaguacaacaacgacagcccgcucaccuucggcggcgggacgaagguggagaucaagcggaccgucgccgcgcccuccguguucaucuucccgcccagcgacgagcagcugaaguccggcaccgccagcguggucugccugcucaacaacuucuacccccgcgaggccaaggugcaguggaagguggacaacgcccugcaguccgggaacagccaggagagcgucaccgagcaggacuccaaggacagcacguacucccugagcuccacccucacccugagcaaggcggacuacgagaagcacaagguguacgccugcgaggugacccaccagggccuguccagccccgucacgaaguccuucaaccgcggggagugc

SEQ ID NO: 12755 - RNA, 645 nt, Artificial Sequence
  derived and/or modified sequence opt1 from anti-influenza_Chain
agcgugcugacccagcccccguccgccagcggcucccgcgggcagagcaucaccaucuccugcacgggcagcaccuccgacaucgggagcuacaacuacgucuccugguaccagcagcaccccggcaccgcccccaaggugauccucuacgaggugagccagcggcccuccggggucccggaccgcuucagcggcuccaagagcggcaacaccgcguuccugacgguguccgggcugcaggccgaggacgaggccgacuacuacugcgccagcuacgccggcaacaacaucuacguguucggguccggcaccaaggucaccgugcucgggcagcccaaggcgaaccccaccgugacgcuguucccgcccagcuccgaggagcugcaggccaacaaggccacccucgucugccugaucagcgacuucuaccccggcgccgugaccguggcguggaaggccgacagcucccccgucaaggccggcguggagaccacgacccccagcaagcaguccaacaacaaguacgccgccagcuccuaccugagccucaccccggagcaguggaagucccacaagagcuacuccugccaggugacccacgaggggagcacggucgagaagaccguggcgcccaccgagugcucc

SEQ ID NO: 12756 - RNA, 645 nt, Artificial Sequence
  derived and/or modified sequence opt1 from anti-influenza_Chain
agcgcccugacccagcccccguccgccagcggcucccgcgggcagagcaucaccaucuccugcacgggcagcaccuccgacaucgggagcuacaacuacguguccugguaccagcagcaccccggcaccgcgcccaaggucauccucuacgaggugagccagcggcccuccggggugccggaccgcuucagcggcuccaagagcggcaacaccgccuuccugacggucuccgggcugcaggccgaggacgaggccgacuacuacugcgccagcuacgcgggcaacaacaucuacguguucggguccggcaccaaggugaccguccucgggcagcccaaggccaaccccaccgugacgcuguucccgcccagcuccgaggagcugcaggccaacaaggccacccucgugugccugaucagcgacuucuaccccggcgcggucaccguggccuggaaggccgacagcucccccgugaaggccggcgucgagaccacgacccccagcaagcaguccaacaacaaguacgccgcgagcuccuaccugagccucaccccggagcaguggaagucccacaagagcuacuccugccaggugacccacgaggggagcacgguggagaagaccgucgcccccaccgagugcucc

SEQ ID NO: 12757 - RNA, 648 nt, Artificial Sequence
  derived and/or modified sequence opt1 from anti-influenza_Chain
cagagcgugcugacccagcccccguccgagagcgucucccccggccagaccgccagcgugacgugcuccgggcacaagcucggcgacaaguacgugagcugguaccagcagaagcccgggcagucccccguccugcugaucuaccaggacaaccgccggccgagcggcauccccgagcgcuucaucggguccaacagcggcaacaccgccacccucaccaucuccggcacgcaggcgcuggacgaggccgacuacuacugccaggccugggacagcuccaccgccguguucgggggcgggaccaagcugaccgugcucggcgccgcggccgggcagcccaaggccgcccccagcgucacgcuguucccgcccuccagcgaggagcugcaggcgaacaaggccacccucgugugccugaucuccgacuucuaccccggcgccgugaccgucgccuggaaggccgacagcucccccgugaaggcgggcguggagaccacgaccccgagcaagcagagcaacaacaaguacgccgccuccagcuaccugucccucacccccgagcaguggaagucccaccggagcuacagcugccaggucacccacgagggguccacgguggagaagaccguggcccccaccgagugcagc

SEQ ID NO: 12758 - RNA, 648 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucgggagcuacaaccucguguccugguaccagcagcaccccggcaaggcgcccaagcugaugaucuacgaggugagcaagcgccccuccggggucagcaaccgguucuccggcagcaaguccggcaacaccgccagccugaccaucuccgggcuccaggccgaggacgaggccgacuacuacugccaccuguacgugggcagcuccaacuggguguucgggggcgggacgaagcuggccguccucggccagccgaaggcggcccccagcgugacccuguucccgcccagcuccaaggagcugcaggccaacaaggccacccucgugugccccaucagcgacuucuaccccggcgcggucaccguggccuggaaggccgacuccagccccgugaaggccggggucgagacgaccacccccuccaagcagagcaacaacaaguacgccgcguccagcuaccugucccugaccccggagcaguggaagucccacaagagcuacagcugccaggugacgcacgagggcuccaccguggagaagaccgucgcccccaccgagugcagc

SEQ ID NO: 12759 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuggccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12760 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuacccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12761 - RNA, 648 nt, Artificial Sequence
  derived and/or modified sequence opt1 from anti-influenza_Chain
gagaucgugaugacccagagccccgccacccuguccgucagcccgggcgagcgcgccacgcucuccugccgggcgagccaguccguggacagcaaccuggccugguaccagcagaagcccgggcaggcgccccgccugcucguguacuccgccagcacccgggccaccggcauccccgcccgcuucuccgggagcggcuccgggaccgaguucacgcuggccaucagcucccugcagagcgaggacuucgccgucuacuacugccagcacuacaccaacuggccgccccggcucaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccuguccagcacccucacgcuguccaaggccgacuacgagaagcacaaggucuacgcgugcgaggugacccaccagggccugagcucccccgugaccaagagcuucaaccgcggggagugc

SEQ ID NO: 12762 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagcuccaaccuggccugguaccagcagaagcccgggcaggcgccccgccuccugguguacagcgccuccacccgggccaccggcauccccgcccgcuucagcggguccggcagcgggaccgaguucacgcuggccaucuccagccuccaguccgaggacuucgccgucuacuacugccagcacuacaccaacuggccgccccggcugaccuucggcggcgggagcaagguggagaucaagcgcaccguggccgcgcccuccgucuucaucuucccgcccagcgacgagcagcugaaguccggcacggccagcguggugugccuccugaacaacuucuacccccgggaggccaagguccaguggaagguggacaacgcccugcagagcgggaacucccaggagagcgugaccgagcaggacuccaaggacagcaccuacucccucagcuccacccugacgcugagcaaggccgacuacgagaagcacaaggucuacgcgugcgaggugacccaccagggccucuccagccccgugaccaaguccuucaaccgcggggagugc

SEQ ID NO: 12763 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggaccacaaccuggccugguaccagcagaagcccgggcaggcgccccgccuccugguguacagcgccuccacccgggccaccggcauccccgcccgcuucagcggguccggcagcgggaccgaguucacgcuggccaucuccagccuccaguccgaggacuucgccgucuacuacugccagcacuacaccaacuggccgccccggcugaccuucggcggcgggagcaagguggagaucaagcgcaccguggccgcgcccuccgucuucaucuucccgcccagcgacgagcagcugaaguccggcacggccagcguggugugccuccugaacaacuucuacccccgggaggccaagguccaguggaagguggacaacgcccugcaguccgggaacagccaggagagcgugaccgagcaggacuccaaggacagcaccuacucccucagcuccacccugacgcugagcaaggccgacuacgagaagcacaaggucuacgcgugcgaggugacccaccagggccucuccagccccgugaccaaguccuucaaccgcggggagugc

SEQ ID NO: 12764 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuggccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12765 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccgugagccacaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuucccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12766 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuucccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12767 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaguccguggacagcaaccuggccugguaccagcagaagcccgggcaggcgccccgccuccugguguacuccgccagcacccgggccaccggcauccccgcccgcuucuccgggagcggcuccgggaccgaguucacgcuggccaucagcucccuccagagcgaggacuucgccgucuacuacugccagcacuacaccaacuacccgccccggcugaccuucggcggcggguccaagguggagaucaagcgcaccguggccgcgcccagcgucuucaucuucccgcccuccgacgagcagcucaagagcggcacggccuccguggugugccugcugaacaacuucuacccccgggaggccaagguccaguggaagguggacaacgcccugcagagcgggaacagccaggaguccgugaccgagcaggacagcaaggacuccaccuacagccucuccagcacccugacgcuguccaaggccgacuacgagaagcacaaggucuacgcgugcgaggugacccaccagggccucagcucccccgugaccaagagcuucaaccgcggggagugc

SEQ ID NO: 12768 - RNA, 648 nt, Artificial Sequence
  derived and/or modified sequence opt1 from anti-influenza_Chain
gagaccacccugacgcagagccccgccacccucuccgugagcccgggcgagcgcgccacccuguccugccgggcgagccaggucaucucccacaaccuggccugguaccagcagaagcccgggcaggcgccccgccuccugaucuacggcgccagcacccgggccuccgggauccccgcccgcuucagcggcuccgggagcggcacggacuacacccugaccaucaccucccuccagagcgaggacuucgccguguacuacugccagcacuacuccaacuggccgccccggcugacguucggcgggggcaccaagguggagaucaagcgcaccgucgccgcccccagcguguucaucuucccgcccuccgacgagcagcucaagagcgggaccgcguccguggucugccugcugaacaacuucuacccccgggaggccaaggugcaguggaagguggacaacgcccugcagagcggcaacucccaggagagcgucacggagcaggacagcaaggacuccaccuacagccucuccagcacccugacccuguccaaggccgacuacgagaagcacaagguguacgccugcgaggugacgcaccaggggcucagcucccccgucaccaagagcuucaaccgcggcgagugc

SEQ ID NO: 12769 - RNA, 648 nt, Artificial Sequence; identical to SEQ ID NO: 8650
  derived and/or modified sequence opt1 from anti-influenza_Chain

SEQ ID NO: 12770 - RNA, 648 nt, Artificial Sequence
  derived and/or modified sequence opt1 from anti-influenza_Chain
gagaucgugcugacccagagccccgccacccucuccgucagccccggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagccggaggacuucgccguguacuacugccagcacuacagcaacuggccgccccggcugaccuucggcgggggcaccaaggucgagaucaagcgcacgguggccgcccccuccgugagcaucuucccgcccuccgacgagcagcucaagagcgggaccgcguccgucgugugccugcugaacaacuucuacccccgggaggccaaggugcaguggaaggucgacaacgcccugcagagcggcaacucccaggagagcgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccgcggcgagugc

SEQ ID NO: 12771 - RNA, 648 nt, Artificial Sequence
  derived and/or modified sequence opt1 from anti-influenza_Chain
gagaucgugaugacccagagccccgccacccuguccgucagcccgggcgagcgcgccacgcucuccugccgggcgagccaggugaucucccacaaccuggccugguaccagcagaagcccgggcaggcgccccgccugcucaucuacggcgccagcacccgggccuccgggauccccgcccgcuucagcggcuccgggagcggcaccgacuacacccugacgaucaccucccugcagagcgaggacuucgccguguacuacugccagcacuacuccaacuggccgccccggcucaccuucggcgggggcaccaaggucgagaucaagcgcacgguggccgcccccagcguguucaucuucccgcccuccgacgagcagcucaagagcgggaccgcguccgucgugugccugcugaacaacuucuacccccgggaggccaaggugcaguggaaggucgacaacgcccugcagagcggcaacucccaggagagcgugaccgagcaggacagcaaggacuccaccuacagccuguccagcacgcucacccuguccaaggccgacuacgagaagcacaagguguacgccugcgaggucacccaccaggggcugagcucccccgugaccaagagcuucaaccgcggcgagugc

SEQ ID NO: 12772 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuucccgccccggcugaccuucggcgggggcaccaaggucgagaucaagcgcacgguggccgcccccagcguguucaucuucccgcccuccgacgagcagcucaagagcgggaccgcguccgucgugugccugcugaacaacuucuacccccgggaggccaaggugcaguggaaggucgacaacgcccugcagagcggcaacucccaggagagcgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccgcggcgagugc

SEQ ID NO: 12773 - RNA, 648 nt, Artificial Sequence
  derived and/or modified sequence opt1 from anti-influenza_Chain
gagaucgugcugacccagagccccgccacccucuccgucagcccgggcgagcgcgccacgcuguccugccgggcgagccaggugaucucccacaaccuggccugguaccagcagaagcccgggcaggcgccccgccuccugaucuacggcgccagcacccgggccuccgggauccccgcccgcuucagcggcuccgggagcggcaccgacuacacccugacgaucaccucccuccagagcgaggacuucgccguguacuacugccagcacuacuccaacuacccgccccggcugaccuucggcgggggcaccaaggucgagaucaagcgcacgguggccgcccccagcguguucaucuucccgcccuccgacgagcagcucaagagcgggaccgcguccgucgugugccugcugaacaacuucuacccccgggaggccaaggugcaguggaaggucgacaacgcccugcagagcggcaacucccaggagagcgugaccgagcaggacagcaaggacuccaccuacagccucuccagcacgcugacccuguccaaggccgacuacgagaagcacaagguguacgccugcgaggucacccaccaggggcucagcucccccgugaccaagagcuucaaccgcggcgagugc

SEQ ID NO: 12774 - RNA, 648 nt, Artificial Sequence
  derived and/or modified sequence opt1 from anti-influenza_Chain
gagaucgugcugacccagagccccgccacccucuccgucagcccgggcgagcgggugacgcuguccugccgggccagccaguccguggcgaacaaccuggccugguaccagcagaagcccgggcagagcccccgccuccugaucuacggcgccuccacccgggacaccgggauccccgcccgcuucagcggcuccgggagcggcaccgaguucacgcugaccaucuccagccuccaguccgaggacuucgccgucuacuacugccagcaguacaacaacuggccgcccauguacaccuucggccaggggaccaagcuggagaucaagcggacgguggcggcccccagcguguucaucuucccgcccuccgacgagcagcucaagagcggcaccgccuccgucgugugccugcugaacaacuucuacccccgcgaggccaaggugcaguggaaggucgacaacgcgcugcagagcgggaacucccaggagagcgugaccgagcaggacagcaaggacuccaccuacagccucuccagcacgcugacccuguccaaggccgacuacgagaagcacaagguguacgccugcgaggucacccaccagggccucagcucccccgugaccaagagcuucaaccgcggggagugc

SEQ ID NO: 12775 - RNA, 648 nt, Artificial Sequence
  derived and/or modified sequence opt1 from anti-influenza_Chain
gacaucgugaugacccagagccccuccacccugagcgccuccgucggcgaccgcgugacgaucacgugccgggccagccaguccaucgggaacuggcucgcgugguaccagcagaagccgggcaaggcccccaagcugcugaucuacaaggugagcacccucgaguccgggguccccagccgcuucuccggcagcggguccggcaccgaguucacccugaccaucaacagccugcagcccgacgacuucgccaccuacuacugccagcgguacaccuccaacagccagggcuucacguucgggcagggcaccaagcucgagaucaagcgcaccguggccgccccguccguguucaucuucccgcccagcgacgagcagcugaaguccgggaccgcgagcgucgugugccugcucaacaacuucuacccccgggaggccaaggugcaguggaaggucgacaacgcccugcaguccggcaacagccaggagagcgugacggagcaggacuccaaggacagcaccuacucccugagcuccacccucacccugagcaaggccgacuacgagaagcacaagguguacgcgugcgaggucacgcaccaggggcuguccagccccgugaccaaguccuucaaccgcggcgagugc

SEQ ID NO: 12776 - RNA, 648 nt, Artificial Sequence
  derived and/or modified sequence opt1 from anti-influenza_Chain
gacauccagcugacccagagcccccucuccccgcccgugacccugggccagcccgccagcaucuccugccgcagcucccagagccugcucuacacggacggguucaccuaccuguccugguaccaccagcggcccggccagagcccgcgccggcugaucuacaagaucuccaaccgcgacagcgggguccccgaccgguucuccggcagcggguccggcaccgacuucacccucaagaucagccgcguggaggccgaggacgugggcgucuacuacugcaugcaggcgacgcacuggccccugaccuucggggagggcaccaagguggagaucaagcccaaggccgccccguccgugacccuguucccgcccagcuccgaggagcuccaggccaacaaggccacgcuggucugccugaucagcgacuucuaccccggggcggugaccguggccuggaaggccgacuccagccccgucaaggccggcguggagaccaccacgcccagcaagcaguccaacaacaaguacgcggccagcuccuaccucagccugacccccgagcaguggaagucccacaagagcuacuccugccaggugacccacgaggggagcaccgucgagaagacgguggcccccaccgagugcucc

SEQ ID NO: 12777 - RNA, 648 nt, Artificial Sequence
  derived and/or modified sequence opt1 from anti-influenza_Chain
gagaucgugcugacccagagccccggcacccucucccugagcccgggggagcgggccacgcuguccugccgggccagccaguccguccgcagcaacaaccucgcgugguaccagcacaagcccggccaggcgccccggcugcugaucuucggggccuccagccgcgccaccggcauccccgaccgguucuccgggagcggcuccggcaccgacuucacccucacgaucagccgccuggagccggaggacuucgccguguacuacugccagcaguacggguccagccccgcccugaccuucggcgggggcaccaagguggagaucaagcggaccgucgccgcccccuccguguucaucuucccgcccagcgacgagcagcucaaguccgggacggccagcguggucugccugcugaacaacuucuacccccgcgaggcgaaggugcaguggaagguggacaacgcccuccaguccggcaacagccaggagagcgucaccgagcaggacuccaaggacagcaccuacucccugagcuccacccugacgcucagcaaggccgacuacgagaagcacaagguguacgccugcgaggugacccaccagggccuguccagccccgucaccaaguccuucaaccgcggggagugc

SEQ ID NO: 12778 - RNA, 648 nt, Artificial Sequence
  derived and/or modified sequence opt1 from anti-influenza_Chain
cagagcgugcugacccagcccccguccgccagcggcucccgcgggcagagcaucaccaucuccugcacgggcagcaccuccgacaucgggagcuacaacuacgucuccugguaccagcagcaccccggcaccgcccccaaggugauccucuacgaggugagccagcggcccuccggggucccggaccgcuucagcggcuccaagagcggcaacaccgcguuccugacgguguccgggcugcagaccgacgacgaggccgacuacuacugcgccagcuacgccggcaacaacaucuacguguucggguccggcaccaaggucaccgugcucgggcagcccaaggccaaccccacggugacccuguucccgcccagcuccgaggagcugcaggcgaacaaggccacccucgucugccugaucagcgacuucuaccccggcgccgugaccguggccuggaaggcggacagcucccccgucaaggccggcguggagacgaccacccccagcaagcaguccaacaacaaguacgccgccagcuccuaccugagccucaccccggagcaguggaagucccacaagagcuacuccugccaggugacgcacgaggggagcaccgucgagaagaccguggcccccaccgagugcucc

SEQ ID NO: 12779 - RNA, 651 nt, Artificial Sequence
  derived and/or modified sequence opt1 from anti-influenza_Chain
cagcccgugcugacccagccgcccagcgccuccggcagccccgggcagcgcgucaccaucuccugcagcggcuccagcuccaacaucgggagcuacacggugaacugguaccagcagcuccccggcaccgccccgaagcugcugaucuacucccucaaccagcggcccagcggggugcccgaccgcuucuccggcagcaaguccggcaccagcgcgucccuggccaucagcgggcugcaguccgaggacgaggccgucuacuacugcgccgccugggacgacagccucuccgcgcacgugguguucggcgggggcaccaagcugacgguccuggggcagcccaaggccgccccgagcgugacccucuucccgcccagcuccgaggagcugcaggccaacaaggcgacccuggugugccucaucagcgacuucuaccccggcgccgucaccguggccuggaaggccgacuccagccccgugaaggccggcgucgagacgaccacccccuccaagcagagcaacaacaaguacgcggccuccagcuaccugucccugacccccgagcaguggaagucccaccggagcuacagcugccaggugacgcacgagggguccaccguggagaagaccgucgcccccaccgagugcagc

SEQ ID NO: 12780 - RNA, 651 nt, Artificial Sequence
  derived and/or modified sequence opt1 from anti-influenza_Chain
cagcccgugcugacccagccgcccagcgccuccggcacccccgggcagcgcgucacgaucagcugcuccggcagcuccagcaacaucggguccaacaccgugagcugguaccagcagguccccggcaccgccccgaagcuccugaucuacgggaacaacgagcggcccuccggcgugcccgaccgcuucagcggcuccaagagcgcgaccuccgccagccuggccaucuccgggcuccagagcgaggacgaggccgacuacuacugcgccgcgugggacgacucccugaacggcuucuggguguucgggggcgggacgaagcugaccgugcucggccagcccaaggccgccccgagcgucacccuguucccgcccuccagcgaggagcugcaggccaacaaggcgacccucgugugccugaucagcgacuucuaccccggcgccgugacggucgccuggaaggccgacuccagccccgugaaggccgggguggagaccaccacccccuccaagcagagcaacaacaaguacgcggccuccagcuaccugucccucacgcccgagcaguggaagucccacaagagcuacagcugccaggucacccacgagggcuccaccguggagaagaccguggcccccacggagugcagc

SEQ ID NO: 12781 - RNA, 651 nt, Artificial Sequence
  derived and/or modified sequence opt1 from anti-influenza_Chain
agcuacgugcugacccagcccccguccgucagcggcacccccgggcagcgcgugaucaucuccugcagcggcuacuccagcaacaucggguccaacacggugaacugguaccagcaguuccccggcaccgcgccccggcuccugaucuacgccaacaaccagcgcccgcccgggguccccgaccgguucagcggcuccaagagcggcaccuccgccagccuggccaucuccgggcuccagagcgacgacgaguccgacuacuacugcgccgccugggacgacagccugaacggccacuggguguucgggggcgggaccaagcugacggugcucggccagcccaaggccgcgccguccgucacccuguucccgcccagcuccgaggagcugcaggccaacaaggccacccucgugugccugaucagcgacuucuaccccggcgccgugaccgucgcguggaaggccgacagcucccccgugaaggccgggguggagacgaccacccccagcaagcaguccaacaacaaguacgccgccagcuccuaccugagccucacccccgagcaguggaagucccaccgcagcuacuccugccaggucacgcacgagggcagcaccguggagaagaccguggcgcccaccgagugcucc

SEQ ID NO: 12782 - RNA, 654 nt, Artificial Sequence
  derived and/or modified sequence opt1 from anti-influenza_Chain
agcuacgugcugacccagcccccguccgucagcguggcccccggccagaccgcccgcaucacgugcgggggcaacaacaucggguccaagagcgugcacugguaccagcagaagcccggccaggcgcccguccucgugguguacgacgacuccgaccggccgagcgggauccccgagcgcuucuccggcagcaacuccggcaacaccgccacccugaccaucagccgggucgaggccggggacgaggccgacuacuacugccaggugugggacuccagcuccgaccacgccguguucggcgggggcacgcagcugaccguccucggggcggccgccggccagcccaaggccgcgcccagcgugacccuguucccgcccuccagcgaggagcugcaggccaacaaggccacccucgugugccugaucuccgacuucuaccccggcgccgucacgguggccuggaaggcggacagcucccccgugaaggccggggucgagaccaccaccccgagcaagcagagcaacaacaaguacgccgccuccagcuaccugucccucacgcccgagcaguggaagucccaccgcagcuacagcugccaggugacccacgagggcuccaccguggagaagaccgucgcccccacggagugcagc

SEQ ID NO: 12783 - RNA, 654 nt, Artificial Sequence
  derived and/or modified sequence opt1 from anti-influenza_Chain
cagagcguggucacccagcccccguccgugagcguggcccccggccagaccgcccgcaucacgugcgggggcaacaacaucggguccaagagcguccacugguaccagcagaagcccggccaggcgcccgugcugguggucuacgacgacuccgaccggccgagcgggauccccgagcgcuucuccggcagcaacuccggcaacaccgccacccucaccaucagccggguggaggccggggacgaggccgacuacuacugccaggugugggacuccagcuccgaccacuacgucuucggcacggggaccaaggugaccgugcugggcgccgcggccgggcagcccaaggccgcccccagcgucacccuguucccgcccuccagcgaggagcuccaggcgaacaaggccacgcuggugugccugaucuccgacuucuaccccggcgccgugaccgucgccuggaaggccgacagcucccccgugaaggcgggcguggagaccaccacgccgagcaagcagagcaacaacaaguacgccgccuccagcuaccucucccugacccccgagcaguggaagucccaccgcagcuacagcugccaggucacccacgagggguccaccguggagaagacgguggcccccaccgagugcagc

SEQ ID NO: 12784 - RNA, 654 nt, Artificial Sequence
  derived and/or modified sequence opt1 from anti-influenza_Chain
cugagccgcaucaaccacuucgagaagauccagaucauccccaaguccagcugguccgaccacgaggccagcuccggcgugagcuccgccugcccguaccaggggacccccagcuucuuccggaacgucguguggcucaucaagaagaacaacaccuaccccacgaucaagcgcuccuacaacaacaccaaccaggaggaccugcugauccucuggggcauccaccacagcaacgacgcggccgagcagaccaagcuguaccagaaccccaccacguacaucuccguggggaccagcacccugaaccagcggcucgucccgaagaucgccacccgcuccaaggugaacggccagaacgggcggauggacuucuucuggacgauccugaagcccaacgacgccaucaacuucgagagcaacggcaacuucaucgcccccgaguacgcguacaagaucgugaagaagggcgacuccgccaucgucaagagcgagguggaguacgggaacugcaacaccaagugccagacccccaucggcgccaucaacuccagcaugccguuccacaacauccacccccugaccaucggggagugccccaaguacgugaaguccaacaagcucguccuggccacgggccugcgcaacagcccccuc

SEQ ID NO: 12785 - RNA, 657 nt, Artificial Sequence
  derived and/or modified sequence opt1 from anti-influenza_Chain
agcuccgagcugacccagcccccgagcgccuccggcacccccgggcagcgggugacgaucagcugcuccggcagcaccuccaacaucggguacaaccccgucagcugguaccagcagguccccggcaccgccccgaagcuccugaucuacuccaacaccgagcggcccagcggggugcccgaccgcuucuccggcagcaaguccggcacgagcgcgucccuggccaucagcgggcuccaguccgaggacgaggccgacuacuacugcgccgccugggacgacacccugaacggccccguguucgggggcgggaccaaggugaccgugcugggccagcggacggucgcggccccgagcguguucaucuucccgcccuccgacgagcagcucaagagcggcaccgccagcguggucugccugcugaacaacuucuacccccgcgaggccaaggugcaguggaagguggacaacgcgcuccaguccgggaacagccaggaguccgucaccgagcaggacagcaaggacuccaccuacagccuguccagcacgcugacccucuccaaggccgacuacgagaagcacaagguguacgccugcgaggugacccaccagggccugagcucccccgucaccaagagcuucaaccgcggggagugc

SEQ ID NO: 12786 - RNA, 657 nt, Artificial Sequence; identical to SEQ ID NO: 8666
  derived and/or modified sequence opt1 from anti-influenza_Chain

SEQ ID NO: 12787 - RNA, 660 nt, Artificial Sequence
  derived and/or modified sequence opt1 from anti-influenza_Chain
agcuacgugcugacccagcccccguccgccagcggcacccccgggcagcgcgucacgaucuccugcagcggcuccaccuucaacaucgggagcaacgccguggacugguaccggcagcuccccggcaccgcgcccaagcugcugaucuacuccaacaaccagcgcccgagcggggugcccgaccgguucuccggcagccgcuccggcaccagcgccucccucgccaucagcgggcugcaguccgaggacgaggccgacuacuacugcgccgcgugggacgacauccugaacguccccguguucggcgggggcacgaagcucaccgugcugggggccgccgccggccagcccaaggcggccccgagcgucacccuguucccgcccuccagcgaggagcuccaggccaacaaggccacccuggugugccugaucuccgacuucuaccccggcgccgugacggucgcguggaaggccgacagcagccccgugaaggccgggguggagaccaccacccccuccaagcagagcaacaacaaguacgccgccuccagcuaccucucccugacgcccgagcaguggaagucccaccggagcuacagcugccaggucacccacgagggcuccaccguggagaagaccguggcgcccacggagugcagc

SEQ ID NO: 12788 - RNA, 660 nt, Artificial Sequence
  derived and/or modified sequence opt1 from anti-influenza_Chain
cagagcgcccugacccagcccgccgcgguguccggcagcccggggcaguccaucaccaucagcugcacgggcaccuccagcgacgucgggggcuacaacuacguguccugguaccagcagcaccccgggaaggcccccaagcucaugaucuacgaggugagcaaccgccccuccggcgucagcaaccgguucuccggcagcaaguccgggaacaccgccagccugaccaucuccggccugcaggccgaggacgaggccgacuacuacugcagcuccuacacgagcuccagcaccuacguguucgggaccggcaccaaggugacgguccucggggcggccgccggccagccgaaggccgcgcccagcgugacccuguucccgcccuccagcgaggagcugcaggccaacaaggccacccucgugugccugaucuccgacuucuaccccggcgccgucaccguggccuggaaggcggacagcucccccgugaaggccggggucgagacgaccacccccagcaagcaguccaacaacaaguacgccgccagcuccuaccugagccucacccccgagcaguggaagucccaccgcagcuacuccugccaggugacgcacgagggcagcaccguggagaagaccgucgccccgaccgagugcucc

SEQ ID NO: 12789 - RNA, 660 nt, Artificial Sequence
  derived and/or modified sequence opt1 from anti-influenza_Chain
agcuacgugcugacccagcccccguccgucagcggcacccccgggcagcgcgugacgaucuccugcagcggcucccggagcaacgugggggacaacuccgucuacugguaccagcacgugcccgagauggcccccaagcuccugguguacaagaacacccagcgcccgagcggcguccccgcccgguucuccgggagcaaguccggcaccagcgcgucccuggccaucaucggccuccagagcggggacgaggccgacuacuacugcguggccugggacgacuccguggacggcuacgucuucgggagcggcaccaaggugacggugcugggggccgcggccggccagcccaaggccgcccccuccgucacccuguucccgcccagcuccgaggagcuccaggcgaacaaggccacccuggugugccugaucagcgacuucuaccccggcgccgugaccgucgccuggaaggccgacagcucccccgugaaggcggggguggagacgaccaccccgagcaagcaguccaacaacaaguacgccgccagcuccuaccucagccugacccccgagcaguggaagucccaccgcagcuacuccugccaggucacgcacgagggcagcaccguggagaagaccguggcccccaccgagugcucc

SEQ ID NO: 12790 - RNA, 660 nt, Artificial Sequence
  derived and/or modified sequence opt1 from anti-influenza_Chain
agcuacgugcugacccagcccccguccgccagcggcacccccgggcagcgcgucacgaucuccugcagcggcuccagcuccaacaucgggagcaacuacguguacugguaccagcagcuccccggcaccgcccccaagcugcugaucuaccgggacgggcagcgcccguccggcgugcccgaccgguucagcggcuccaagagcgggaccuccgcgagccucgccaucuccggccugcgcagcgacgacgaggccgacuacuacugcgccaccugggacgacaaccuguccgggcccgucuucggcgggggcacgaagcucaccgugcugggcgccgcggccgggcagcccaaggccgccccgagcgugacccuguucccgcccuccagcgaggagcuccaggcgaacaaggccacccuggucugccugaucagcgacuucuaccccggcgccgugacgguggccuggaaggccgacuccagccccgucaaggcggggguggagaccaccacccccuccaagcagagcaacaacaaguacgccgccuccagcuaccucucccugacgcccgagcaguggaagucccaccggagcuacagcugccaggugacccacgagggcuccaccgucgagaagaccguggcccccacggagugcagc

SEQ ID NO: 12791 - RNA, 660 nt, Artificial Sequence
  derived and/or modified sequence opt1 from anti-influenza_Chain
cagagcgcccugacccagcccgccuccgugagcggcuccccggggcagagcaucaccaucuccugcacgggcaccagcuccgacgucgggggcuacaacuacgugagcugguaccagcagcaccccgggaaggcgcccaagcucaugaucuacgagguguccaaccgccccagcggcgucuccaaccgguucagcggcuccaagagcgggaacaccgccucccugaccaucagcggccugcaggccgaggacgaggccgacuacuacugcuccagcuacacguccagcagcacccucguguucgggaccggcaccaaggugacgguccugggggccgcggccggccagccgaaggccgcccccuccgugacccuguucccgcccagcuccgaggagcuccaggcgaacaaggccacccuggugugccugaucagcgacuucuaccccggcgccgucaccguggccuggaaggccgacuccagccccgugaaggcgggggucgagacgaccacccccuccaagcagagcaacaacaaguacgccgccuccagcuaccucucccugacccccgagcaguggaagucccaccgcagcuacagcugccaggugacgcacgagggcuccaccguggagaagaccgucgccccgaccgagugcagc

SEQ ID NO: 12792 - RNA, 660 nt, Artificial Sequence
  derived and/or modified sequence opt1 from anti-influenza_Chain
accgugcugacccagcccccgagcgucuccggcgcccccgggcagcgcgugacgaucagcugcaccggcuccagcuccaacaucggggccggcuacgacgugcacugguaccagcagcuccccgggaccgcgcccaagcugcugaucuacggcaacagcaaccggccguccggcguccccgaccgcuucagcggguccaagagcggcaccuccgccacgcucgggaucaccggccugcagaccggggacgaggccgacuacuacugcggcaccugggacagcucccugagcgccuacguguucggcacggggaccaaggugaccguccucggcgccgcggccgggcagcccaaggccgcccccuccgugacccuguucccgcccagcuccgaggagcugcaggcgaacaaggccacgcucgugugccugaucagcgacuucuaccccggcgccgucaccguggccuggaaggccgacuccagccccgugaaggcgggcgucgagaccaccacgccgagcaagcaguccaacaacaaguacgccgccagcuccuaccugagccucacccccgagcaguggaagucccaccggagcuacuccugccaggugacccacgaggggagcaccguggagaagacggucgcccccaccgagugcucc

SEQ ID NO: 12793 - RNA, 663 nt, Artificial Sequence
  derived and/or modified sequence opt1 from anti-influenza_Chain
cagagcgugcugacccagcccccguccgucagcgccgcccccggccagaaggugaccaucuccugcagcggguccagcuccaacaucggcaacgacuacgugagcugguaccagcagcuccccgggacggcgcccaagcugcugaucuacgacaacaacaagcgcccguccggcauccccgaccgguucagcggguccaagagcggcaccuccgccacccucggcaucaccgggcugcagacgggcgacgaggccaacuacuacugcgccaccugggaccgccggcccaccgccuacgucguguucgggggcgggaccaagcugacggugcucggcgcggccgccggccagcccaaggccgcgccgagcgucacccuguucccgcccuccagcgaggagcugcaggccaacaaggccacccucgugugccugaucuccgacuucuaccccggggccgugaccgucgccuggaaggcggacagcucccccgugaaggccggcguggagacgaccacccccagcaagcagagcaacaacaaguacgccgccuccagcuaccugucccucacccccgagcaguggaagucccaccgcagcuacagcugccaggucacgcacgagggguccaccguggagaagaccguggcccccaccgagugcagc

SEQ ID NO: 12794 - RNA, 675 nt, Artificial Sequence
  derived and/or modified sequence opt1 from anti-influenza_Chain
auggugggcuucacccccgucgcccuggccgcgcucgccgccaccggggcccuggccuucccggcgggcaacgccacggagcuggagaagcgccagaccacccccaacagcgagggguggcacgacggcuacuacuacuccugguggagcgacgggggcgcccaggccaccuacacgaaccucgagggcgggaccuacgagaucuccuggggcgacgggggcaaccuggucgggggcaagggcuggaaccccgggcugaacgcgcgggccauccacuucgagggcguguaccagcccaacgggaacagcuaccucgccguguacggcuggacccgcaacccgcugguggaguacuacaucguggagaacuucggcaccuacgaccccuccagcggggccacggaccugggcaccgucgagugcgacggguccaucuaccggcucggcaagaccacccgcgugaacgcccccagcaucgacgggacgcagaccuucgaccaguacugguccgugcggcaggacaagcgcaccagcggcaccguccagacgggcugccacuucgacgcgugggcccgggccgggcugaacgugaacggcgaccacuacuaccagaucguggccaccgagggguacuucuccagcggcuacgcccgcaucaccgucgcggacgugggg

SEQ ID NO: 12795 - RNA, 687 nt, Artificial Sequence
  derived and/or modified sequence opt1 from anti-influenza_Chain
cgcagcgacaagacccacacgugcccgcccugccccgcccccgagcugcucggcgggcccuccguguuccuguucccgcccaagcccaaggacacccugaugaucagccggacccccgaggugaccugcgucguggucgacgugucccacgaggacccggaggugaaguucaacugguacgucgacggcguggaggugcacaacgccaagaccaagccccgcgaggagcaguacaacagcacguaccgggucguguccgugcucaccguccugcaccaggacuggcugaacgggaaggaguacaagugcaaggugagcaacaaggcgcuccccgcccccaucgagaagaccaucuccaaggccaagggccagccgcgcgagccccagguguacacccugccgcccagccgggaggagaugacgaagaaccaggucucccugaccugccucgugaagggguucuaccccagcgacaucgccguggagugggaguccaacggccagcccgagaacaacuacaagaccaccccgcccguccuggacagcgacggcuccuucuuccuguacagcaagcucacgguggacaagucccgcuggcagcaggggaacguguucagcugcuccgucaugcacgaggcccugcacaaccacuacacccagaagucccugagccucagccccggcaag

SEQ ID NO: 12796 - RNA, 696 nt, Artificial Sequence
  derived and/or modified sequence opt1 from anti-influenza_Chain
cacgcccaggacauccuggagaagacccacaacggcaagcucugcgaccuggacggggugaagccccugauccuccgcgacugcagcgucgccggcuggcugcuggggaacccgaugugcgacgaguucaucaacgugcccgagugguccuacaucguggagaaggcgaaccccgccaacgaccucugcuaccccggcaacuucaacgacuacgaggagcugaagcaccuccugagccggaucaaccacuucgagaagauccagaucaucccgaaguccagcugguccgaccacgaggccagcuccggggucagcuccgccugccccuaccagggcacccccagcuucuuccgcaacgugguguggcugaucaagaagaacaacacguaccccaccaucaagcgguccuacaacaacaccaaccaggaggaccugcucauccuguggggcauccaccacagcaacgacgccgcggagcagaccaagcuguaccagaacccgacgaccuacaucuccgucgggaccagcacccucaaccagcgccuggugcccaagaucgccacgcgguccaaggugaacggccagaacgggcgcauggacuucuucuggaccauccugaagcccaacgacgccaucaacuucgagagcaacggcaacuucaucgcccccgaguacgcguacaagaucgucaagaag

SEQ ID NO: 12797 - RNA, 699 nt, Artificial Sequence
  derived and/or modified sequence opt1 from anti-influenza_Chain
augcgccccagcauccaguuccugggccuccugcuguucuggcuccacgggggccagugcgacauccagaugacccaguccccgagcucccugagcgccucccucgggggcaacgugaccaucacgugcaaggccagccaggacaucaacaaguacaucgcgugguaccagcacaagcccgggaagggcccccggcuggucauccacuacaccuccacccugcagcccggcaucccgagccgcuucuccgggagcggcuccgggaccgacuacagcuucuccaucagcaaccuggagcccgaggacaucgccacguacuacugccuccaguacgacauccuguacaccuucggcgggggcaccaagcuggagaucaagcgggccgacgccgcccccaccguguccaucuucccgcccagcuccgagcagcucacgagcggcggggcguccguggucugcuuccugaacaacuucuaccccaaggacaucaacgugaaguggaagaucgacggcagcgagcgccagaacggggugcugaacagcuggaccgaccaggacuccaaggacagcaccuacuccaugagcuccacccucacgcugaccaaggacgaguacgagcggcacaacagcuacacgugcgaggccacccacaagaccuccaccagccccaucgucaaguccuucaaccgcaacgagugc

SEQ ID NO: 12798 - RNA, 702 nt, Artificial Sequence
  derived and/or modified sequence opt1 from anti-influenza_Chain
augaugagcuccgcccaguuccugggccuccugcugcucugcuuccaggggacccgcugcgacauccagaugacccagacgagcuccagccuguccgccagccugggcgaccgggugaccaucuccugccgcgcgagccaggacauccggaacuaccucaacugguaccagcagaagcccgacgggaccgucaagcugcugaucuacuacaccucccgccuccacagcggcgugccgucccgguucagcgacuccgggagcggcacggacuacucccugaccaucagcaaccuggagcaggaggaccucgccaccuacuucugccagcagaccuacacgcugcccuggaccuucggcgggggcaccaagcuggagaucaagcgcgccgacgccgcccccaccguguccaucuucccgcccagcuccgagcagcucacgagcgggggcgcgagcgucgugugcuuccugaacaacuucuaccccaaggacaucaacgugaaguggaagaucgacggguccgagcggcagaacggcguccugaacagcuggaccgaccaggacuccaaggacagcaccuacuccaugagcuccacccucacgcugaccaaggacgaguacgagcgccacaacagcuacacgugcgaggccacccacaagaccuccaccagccccaucgugaaguccuucaaccggaacgagugc

SEQ ID NO: 12799 - RNA, 702 nt, Artificial Sequence
  derived and/or modified sequence opt1 from anti-influenza_Chain
auggaggcccccgcccagcuccuguuccugcugcuccuguggcugccggacaccaccggcgagaucgugcucacgcagagccccgcgacccugucccugagccccggggagcgcgccacccucuccugccgggccagcgagaacaucuggaacaaccuggccugguaccagcagaagcccggccaggccccgcgccugcucaucuccggggcgagcaccggcgccacggggguccccucccgguuccgcggcagcggcucccggaccgaguucacccugaccaucagcucccugcagagcgaggacuucgccaucuacuucugccagcaguacaacuccuggccccgcacguucgggcccggcaccaagguggagaucaagcggaccguggccgcgccgagcgucuucaucuucccgcccuccgacgagcagcucaagagcgggaccgccuccguggugugccugcugaacaacuucuacccccgcgaggccaagguccaguggaagguggacaacgcccuccagagcggcaacucccaggagagcgugacggagcaggacagcaaggacuccaccuacagccuguccagcacccugacccucuccaaggccgacuacgagaagcacaaggucuacgcgugcgaggugacgcaccaggggcugagcucccccgugaccaagagcuucaaccggggcgagugc

SEQ ID NO: 12800 - RNA, 705 nt, Artificial Sequence
  derived and/or modified sequence opt1 from anti-influenza_Chain
auggagacccccgcccagcuccuguuccugcugcuccuguggcugccggacaccacgggcgagaucgugcucacccagagccccgggacccugucccugagccccggcgagcgcgccacccucuccugccgggcgagccagucccugagcuccagcucccuggucugguaccagcagaagcccgggcaggccccgcgccuccugaucuacggcgccagcucccgggccacggggauccccgaccgcuucagcggcuccggcagcgggaccgacuucacccugaccaucucccggcucgagcccgaggacuucgccguguacuacugccagcaguacggcaacagccccuacacguucgggcagggcacccagguggagaucaagcgcaccgucgcggccccguccguguucaucuucccgcccagcgacgagcagcugaaguccgggaccgccagcguggucugccugcucaacaacuucuacccccgggaggccaaggugcaguggaagguggacaacgcgcugcagagcggcaacucccaggagagcgucacggagcaggacuccaaggacagcaccuacucccugagcuccacccucacccugagcaaggccgacuacgagaagcacaagguguacgccugcgaggugacgcaccagggccuguccagccccgucaccaaguccuucaaccgcggggagugc

SEQ ID NO: 12801 - RNA, 705 nt, Artificial Sequence
  derived and/or modified sequence opt1 from anti-influenza_Chain
auggagacccccgcccagcuccuguuccugcugcuccuguggcugccggacaccacgggcgagaccgugcucacccagagccccgggacccugucccugagccccggcgagcgcgccacgcucuccugccgggcgagccaguccgucagcaucuccuaccuggccugguaccagcgcaagcccgggcaggccccgcggcugcucaucuacggcgccagccgccgggccaccgggauccccgaccgcuucuccggcagcggcuccgggaccgacuucacccugacgaucagccggcuggagcccgaggacuucgcgguguacuacugccagcaguacggcuccagccccuacaccuucgggcagggcaccaagcucgagaucaagcgcaccguggccgccccguccgucuucaucuucccgcccagcgacgagcagcugaaguccgggacggccagcguggugugccugcucaacaacuucuacccccgggaggcgaagguccaguggaagguggacaacgcccugcaguccggcaacagccaggagagcgugaccgagcaggacuccaaggacagcaccuacucccugagcuccacccucacgcugagcaaggccgacuacgagaagcacaaggucuacgccugcgaggugacccaccagggccuguccagccccgugaccaaguccuucaaccgcggggagugc

SEQ ID NO: 12802 - RNA, 705 nt, Artificial Sequence
  derived and/or modified sequence opt1 from anti-influenza_Chain
auggccuggaugaugcugcuccugacccugcucauccacugcaccggcagcugggcccaguccgugcugacgcagcccccgagcgucuccgcggcccccgggcagaaggugaccaucagcugcuccggcagcuccagcaacaucgggaagaacuacguguccugguaccagcagcugcccggcaccgcccccaagcuccugaucuacgacaacgacaagcgcccgagcgggauccccgaccgguucuccggcagcaaguccggcaccagcgccacgcuggggaucaccggccuccagaccggggacgaggccgacuaccacugcggcgcgugggacuccagccugaacgggggcgucuucggcgggggcaccaaggugacggugcuggggcagcccaaggccgcccccuccgucacccucuucccgcccagcuccgaggagcugcaggccaacaaggcgacccuggugugccucaucagcgacuucuaccccggcgccgugaccgucgccuggaaggccgacagcucccccgugaaggccggcguggagacgaccaccccgagcaagcaguccaacaacaaguacgcggccagcuccuaccugagccugacccccgagcaguggaagucccaccgcagcuacuccugccaggucacgcacgaggggagcaccguggagaagaccguggcccccaccgagugcucc

SEQ ID NO: 12803 - RNA, 714 nt, Artificial Sequence
  derived and/or modified sequence opt1 from anti-influenza_Chain
augaugaagaagaaguccugguucacccugaugaucaccggcgugaucagccucuucuucagcgucuccgccuucgccgggaacguguucugggagccccugagcuacuucaacuccagcacguggcagaaggcggacggcuacuccaacgggcagauguucaacugcaccuggcgcgccaacaacgugaacuucaccaacgacggcaagcugaagcucagccugaccuccccggccaacaacaaguucgacugcggggaguaccggagcacgaacaacuacggcuacggccuguacgaggucuccaugaagcccgccaagaacaccgggaucgugagcuccuucuucaccuacaccggccccagccacgggacgcagugggacgagaucgacaucgaguuccucggcaaggacaccaccaaggugcaguucaacuacuacaccaacggggucggcggccacgagaagaucaucaaccugggguucgacgccuccacgagcuuccacaccuacgcguucgacuggcagcccggcuacaucaagugguacguggacggggugcugaagcacaccgccaccacgaacaucccguccacccccggcaagaucaugaugaaccucuggaacggcaccggggucgacagcuggcugggcuccuacaacggggccaacccccuguacgccgaguacgacugggugaaguacaccagcaac

SEQ ID NO: 12804 - RNA, 729 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaccuucuccagcuacgcgaucuccugggugcgccaggccccgggccaggggcucgaguggaugggcggcaucauggggauguucggcaccacgaacuacgcccagaaguuccaggggcgggugaccaucaccgccgacgaguucaccagcgccgcguacauggagcugcgcucccugcggagcgaggacacggccgucuacuacugcgcccgcuccagcggcuacuaccccgaguacuuccaggacugggggcagggcacccucgugaccguguccagcggcaccgggggcuccgggggcacgggcagcgggaccggcggguccacccagagcguccugacccagccgcccuccgagagcgugagccccggccagacggccuccgugaccugcagcgggcacaagcugggcgacaaguacgucuccugguaccagcagaagcccggccagagccccgugcuccugaucuaccaggacaaccggcgccccuccgggaucccggagcgguucaucggcagcaacuccgggaacaccgcgacccugacgaucagcggcacccaggcccucgacgaggccgacuacuacugccaggccugggacuccagcaccgccguguucgggggcggcaccaagcugacgguccugggg

SEQ ID NO: 12805 - RNA, 729 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggccguuccgcaacuucgcgaucaacugggugcggcaggcccccggccaggggcucgaguggaugggcggcaucaucgccguguucgggaccaccaaguacgcccacaaguuccagggccgcgucacgaucaccgccgacgacuccaccaacaccgcguacauggagcuggggagccugaaguccgaggacacggccguguacuacugcgcccggggcccccacuacuacagcuccuacauggacguguggggcgaggggaccaccgucaccgugagcuccggcaccgggggcagcgggggcaccggcuccgggaccggcgggagcaccgacauccagcucacgcagucccccagcucccugagcgccuccgugggcgaccgcgucaccaucacgugccgggcgagccaggggaucagcaccuaccuggccugguaccagcagaagccgggcaaggugcccaagcuccugaucuacgccgccuccacgcugcagagcggcgugcccucccgcuucagcggguccggcagcgggaccgacuucacccucaccaucuccagccugcagcccgaggacgucgccacguacuacugccagaaguacaacuccgcgccgagcuucggccccgggaccaagguggacaucaagcgg

SEQ ID NO: 12806 - RNA, 729 nt, Artificial Sequence
  derived and/or modified sequence opt1 from anti-influenza_Chain
augagcuaccgcgugaagcggaugcugaugcuccuggucaccggccuguuccucucccugagcaccuucgccgccuccgcgagcgcccagaccgggggcuccuucuacgagcccuucaacaacuacaacaccgggcuguggcagaaggccgacggcuacagcaacgggaacauguucaacugcaccuggcgcgccaacaacguguccaugaccagccucggcgagaugcggcugucccugacgagcccguccuacaacaaguucgacugcggcgagaaccgcagcgugcagaccuacggguacggccucuacgaggucaacaugaagcccgccaagaacguggggaucguguccagcuucuucaccuacaccggccccacggacgggacccccugggacgagaucgacaucgaguuccugggcaaggacaccaccaagguccaguucaacuacuacacgaacggcguggggaaccacgagaagaucgugaaccugggcuucgacgcggccaacuccuaccacaccuacgccuucgacuggcagccgaacagcaucaagugguacgucgacgggcagcucaagcacaccgccaccacgcagaucccccagacccccggcaagaucaugaugaaccuguggaacggcgcggggguggacgaguggcugggcuccuacaacggggugacgccccucagccggucccugcacuggguccgcuacaccaagcgg

SEQ ID NO: 12807 - RNA, 735 nt, Artificial Sequence
  derived and/or modified sequence opt1 from anti-influenza_Chain
caggugcagcugcagcagagcggcgccgaggucaagaagcccggguccagcgugaagguguccugcaaggucagcggcgugaucuucuccgggagcgccaucuccugggugcgccaggcgccgggccaggggcucgaguggaugggcggcaucagcccccuguucgggaccaccaacuacgcccagaaguuccagggccgggucacgaucaccgccgaccaguccaccaacaccacguacauggaggugaacagccugcgcuacgaggacaccgccguguacuucugcgcccgggggcccaaguacuacuccgaguacauggacgucuggggcaaggggaccaccgugacggugagcuccggcaccggcgggagcggcgggaccggcuccggcaccgggggcagcacggacauccagaugacccagucccccagcucccucagcgcgagcgucggggaccgcgugaccaucacgugccgggccucccagggcaucagcuccuaccuggccugguaccagcagaagccggggaaggugcccacccugcucaucuacgacgccagcacccugcgcuccggcguccccagccgguucuccggcagcggguccgcgaccgacuucacccugacgaucagcucccuccagcccgaggacguggccaccuacuacugccagcgcuacaacagcgccccgcccaucaccuucggccaggggacccggcuggagaucaagcgc

SEQ ID NO: 12808 - RNA, 735 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacggcaucuccugggugcgccaggccccggggcagggccucgaguggaugggcgacaucaucgggauguucggcagcaccaacuacgcccagaacuuccaggggcggcugacgaucaccgccgacgaguccaccagcaccgccuacauggagcuguccagccuccgcuccgaggacacggccguguacuacugcgcgcggagcuccggcuacuaccccgccuaccugccccacugggggcagggcacccuggucaccgugagcuccggcaccgggggcagcgggggcacgggcuccgggaccggcgggagcaccgagaucgugcucacccagagccccggcacgcugucccugagcccgggggagcgcgccacccucuccugccgggccagccaguccgucagcuccagcuaccuggcgugguaccagcagaagcccggccaggcgccccgccugcucaucuacggcgccuccagccgggccaccgggauccccgaccgcuucuccggcagcggguccggcaccgacuucacgcugaccaucagccggcuggagccggaggacuucgccguguacuacugccagcaguacggguccagcccccgcaccuucggcggcgggaccaagguggagaucaagcgg

SEQ ID NO: 12809 - RNA, 735 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacgcgaucuccugggugcgccaggccccgggccaggggcucgaguggaugggcggcaucaucgggauguucggcaccgccaacuacgcccagaaguuccaggggcgggugacgaucaccgccgacgaguucaccagcaccgcguacauggagcuguccagccugcgcuccgaggacacggccgucuacuacugcgcccggggcaacuacuacuacgagagcucccucgacuacugggggcagggcacccuggugaccgugagcuccggcaccgggggcagcgggggcacgggcuccgggaccggcgggagcacccaguccgucgugacccagccgcccagcgugagcgucgcccccggccagacggcgcgcaucacgugcgggggcaacaacaucggcuccaagagcgugcacugguaccagcagaagcccgggcaggcccccgugcuggucguguacgacgacuccgaccggcccagcggcauccccgagcgcuucuccgggagcaacuccggcaacaccgccacccucaccaucagccggguggaggccggggacgaggccgacuacuacugccaggucugggacuccagcuccgaccacuacguguucggcaccggcaccaaggugaccguccugggg

SEQ ID NO: 12810 - RNA, 735 nt, Artificial Sequence
  derived and/or modified sequence opt1 from anti-influenza_Chain
gaggugcagcugguccagagcggcgccgaggugaagaagcccggggccuccgugaaggucagcugcaaggcguccggcuacaccuucaccggguacuacguguacugggugcgccaggccccgggccaggggcucgaguggaugggcuggaucagcgccuacaacggcaacacgaacuacgcccagaaguuccaggggcgggucaccaucaccgccgacaaguccaccagcacggcguacauggagcuguccagccugcgcuccgaggacaccgccguguacuacugcgcccggagccgcucccucgacguguggggccaggggaccaccgucacggugagcuccggcaccgggggcagcggcgggaccggcuccgggaccggcggcagcacggacguggucaugacccagucccccgacagccuggccgugucccugggggagcgggcgaccaucaacugcaagagcagccaguccgugcucuacagcuccaacaacaagaacuaccuggccugguaccagcagaagcccggccagcccccgaagcugcucaucuacugggccagcacccgcgaguccgggguccccgaccgguucagcggcuccgggagcggcacggacuucacccugaccaucuccagccugcaggccgaggacguggccguguacuacugccagcaguacuacuccacgccccucaccuucggcgggggcaccaaggucgacaucaagcgc

SEQ ID NO: 12811 - RNA, 735 nt, Artificial Sequence
  derived and/or modified sequence opt1 from anti-influenza_Chain
gaggugcagcuggucgagaccggcgccgaggugaagaagcccgggagcuccgugaaggucccgugcaagagcuccggcagccccuuccgcuccaacgccgugagcugggugcggcaggcgcccgggcagggccucgagugggucgggggcauccugggcguguucgggucccccagcuacgcccagaaguuccagggccgcgugaccaucacggccgacgaguccaccaacaccguccacauggagcugcgggggcuccgcagcgaggacaccgccguguacuacugcgcccggggcccgacguacuacuacuccuacauggacgugugggggaagggcaccaccgucaccgugagcuccggcaccgggggcagcgggggcaccggcuccgggaccggcgggagcaccuccuacgugcugacgcagccgcccagcgaguccgucgcgcccggccagaccgcccgcaucacgugcgggggcaacaacaucggccggaacagcgugcacugguaccagcagaagcccgggcaggcccccgugcuggucguguacgacgacagcgaccgccccuccggcauccccgagcgguucagcggguccaagagcggcaacaccgccacgcucaucaucucccgcguggaggucggggacgaggcggacuacuacugccagguguggcacagcuccagcgaccacuacguguucggcaccggcaccaaggucaccgugcugggg

SEQ ID NO: 12812 - RNA, 735 nt, Artificial Sequence
  derived and/or modified sequence opt1 from anti-influenza_Chain
cagaugcagcuggugcagagcggcgccgaggucaagaagcccggguccagcgugaagguguccugcaaggccagcggcgggaccuucuccagcuacgcgaucuccuggguccgccaggccccgggccaggggcucgaguggaugggcggcaucuucgggauguucggcaccgccaacuacgcccagaaguuccaggggcgggugacgaucaccgccgacgaguucaccagcgcggccuacauggagcuguccagccugggcuccgaggacaccgccauguacuacugcgcccgcagcuccggguacuacccccaguacuuccaggacuggggccagggcacgcucgugaccgucagcuccgggaccggcgggagcggcggcaccggguccggcaccgggggcagcacggagaucgugaugacccagucccccgggacccugagccugagccccggccagcgggcgacgcucuccugccgcgccagccaguccgugagcuccagcuaccuggccugguaccagcagaagccgggccaggcgccccggcugcucauguacggggccuccagccgcgccaccggcauccccgaccgguucuccgggagcggcuccgggaccgacuucacccugacgaucagccgccuggagcccgaggacuucgccgucuacuacugccagcaguacggcuccagcucccucaccuucggcgggggcaccaagcuggagaucaagcgg

SEQ ID NO: 12813 - RNA, 735 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgugaccuucuccuacuacgcgaugagcugggugcgccaggccccggggcagggccucgaguggaugggcgggaucucccccauguucggcaccacgaccuacgcccagaaguuccaggggcgggucaccaucaccgccgacgacagcacguccaccgccuacauggaggugcgcagccugcgguccgaggacaccgcgguguacuacugcgcccgcagcuccaacuacuacgacagcgucuacgacuacuggggccaggggacccuggugacgguguccagcggcaccgggggcuccggcgggaccggcagcgggaccggcggcuccacgcagagcgucgugacccagccgcccagcgaguccguggcccccgggcagaccgcccggaucacgugcggcgggcacaacaucggcagcaacuccguccacugguaccagcagaagcccgggcaggcgcccgugcucguggucuacgacaacagcgaccgccccuccggcaucccggagcgguucagcggcuccaacagcgggaacaccgccacccugaccaucucccgcguggaggccggcgacgaggccgacuacuacugccaggugugggggagcuccagcgaccacuacgucuucggcaccgggacgaaggugaccgugcugggc

SEQ ID NO: 12814 - RNA, 738 nt, Artificial Sequence
  derived and/or modified sequence opt1 from anti-influenza_Chain
caggugcagcugguccagagcggcgggggccucgugaagcccgggggcucccugcgccugagcugcgccgccuccggguucaccuucagcuccuacagcaugaacugggugcggcaggcgccgggcaagggccucgagugggucuccagcaucuccagcuccagcuccuacaucuacuacguggacagcgugaaggggcgcuucaccaucucccgggacaacgccaagaacagccuguaccugcagaugaacucccuccgcgccgaggacacggccgucuacuacugcgcccggggcgggggcagcuacggggcguacgagggcuucgacuacuggggccaggggacccuggugaccguguccagcggcaccgggggcagcggcgggacgggcuccgggaccggcgggagcaccgagaucguccugacccagucccccggcacgcucagccugucccccggcgagcgcgccacccugagcugccgggccucccagcgcgugagcuccuaccucgccugguaccagcagaagcccgggcaggcgccgcggcugcugaucuacggcgccagcacccgcgccgccgggauccccgaccgguucuccggcagcggguccggcaccgacuucacgcucaccaucagccgccuggagcccgaggacuccgccguguacuacugccagcaguacggccggacgccccugaccuucgggggcgggaccaaggucgagaucaagcgc

SEQ ID NO: 12815 - RNA, 738 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcaccggcuccgggaccggcgggagcaccuccuacgugcugacgcagccgcccagcgucuccguggcccccggccagaccgcccggaucacgugcgggggcaacaacaucggcagcaaguccgugcacugguaccagcagaagcccgggcaggcgcccguccucgugguguacgacgacagcgaccgccccagcggcauccccgagcgguucuccgggagcaacuccggcaacaccgccacgcugaccaucagccgcgucgaggccggggacgaggccgacuacuacugccaggugugggacuccagcuccgaccacgccguguucggcggcgggacccagcugaccguccucggc

SEQ ID NO: 12816 - RNA, 738 nt, Artificial Sequence
  derived and/or modified sequence opt1 from anti-influenza_Chain
gaggugcagcuggucgagaccggcgccgaggugaagaagcccggggccagcgugaaggucuccugcaaggcgagcggcuacaccuucacguccuacuacaugcacugggugcgccaggccccggggcagggccucgaguggaugggguggaucaaccccaacagcggcggcaccaacuacgcccagaaguuccaggggcgggugaccaugacccgcgacacguccaucagcaccgccuacauggagcugucccggcugcgcagcgacgacaccgccgucuacuacugcgcgcgggagggcaagugggggccccaggccgccuucgacaucuggggccaggggaccauggugacgguguccagcggcaccggcggguccggcgggaccggcagcggcaccgggggcuccacggagaucgucaugacccagagccccgggacccucucccugagcccgggcgagcgcgccacccuguccugccgggcgagccaguccgugagcagcuccuaccucgccugguaccagcagaagcccgggcaggcgccccgccugcugaucuacgacgccagcucccgggccacggacauccccgaccgcuucagcggcuccggcagcgggaccgacuucacccucaccaucucccggcuggagccggaggacuucgccguguacuacugccagcaguacggcagcucccuguggacguucgggcagggcaccaaggucgagaucaagcgc

SEQ ID NO: 12817 - RNA, 738 nt, Artificial Sequence
  derived and/or modified sequence opt1 from anti-influenza_Chain
gaggugcagcuggucgagagcggcgggggccucgugcagcccgggggcucccugcgccugagcugcgccgccuccggguucaccuucagcaucuacgcgauguccugggugcggcaggccccgggcaagggccucgagugggucagcgccaucuccagcuccggggacagcaccuacuacgccgacuccgugaagggccgcuucacgaucagccgggacaacgcccgcaacacccuguaccugcagaugaacucccuccgggcggaggacaccgccguguacuacugcgcccgcgccuacggguacaccuucgaccccuggggccaggggacgcuggucaccgugagcuccggcaccggcgggagcggcgggaccggcuccggcaccgggggcagcaccgagaucgugcugacccagagcccccucucccugcccgucaccccgggggagcccgcgagcaucuccugccggagcucccagagccugcuccacuccaacggcuacaacuaccuggacugguaccugcagaagcccgggcagagcccccagcuccugaucuaccugggcuccaaccgcgccagcggcgugccggaccgguucuccgggagcggcuccgggacggacuucacccucaagaucagccgcguggaggccgaggacgucggcguguacuacugcaugcaggcccugcagacgccccugaccuucgggggcggcacgaagguggagaucaagcgg

SEQ ID NO: 12818 - RNA, 738 nt, Artificial Sequence
  derived and/or modified sequence opt1 from anti-influenza_Chain
gaggugcagcuggucgagaccggcgccgaggugaagaagcccgggagcuccgugaaggucagcugcaaggccuccggcgggaccuuccgcacgcacgcgaucagcugggugcggcaggccccgggccaggggcucgaguggaugggcggcaucaucgccaucuucgggaccgccaacuacgcccagaaguuccagggccgcaucaccaucaccgcggacgaguccacgagcaccgccuacauggagcuguccagccugcgguccgaggacaccgccguguacuucugcgcccgcgggagcggcuaccacaucuccacccccuucgacaacugggggcagggcacgcucgucaccgugagcuccggcaccgggggcagcgggggcaccggcuccgggacgggcgggagcaccuccuacgugcugacccagccgcccagcgucuccguggcgcccggccagaccgcccggaucacgugcgggggcaacaacaucggcagcaagggggugcacugguaccagcagaagcccggccaggcccccguccuggugguguacgacgacagcgaccgccccuccgggaucccggagcgguucagcggcuccaacagcgggaacaccgccacccucaccaucucccgcgucgaggccggcgacgaggcggacuacuacugccaggugugggacagcuccagcgaccacguggucuucggcgggggcacgaagcugaccgugcugggg

SEQ ID NO: 12819 - RNA, 738 nt, Artificial Sequence
  derived and/or modified sequence opt1 from anti-influenza_Chain
gaggugcagcugguccaguccggcgccgaggugaagaagcccggguccagcgugaaggucuccugcaaggccagcggcgggaucuuccgcuccaacagcaucuccugggugcggcaggcgccgggccaggggcucgaguggaugggcggcaucuucgcccuguucgggaccaccgacuacgcccagaaguuccagggccgcgugacgaucaccgccgacgagagcuccaccaccgucuaccuggagcucagcucccugacgagcgaggacaccgccguguacuacugcgcgcggggguccggcuacaccacccgcaacuacuucgacuacugggggcagggcacgcuggugaccgucagcuccggcaccgggggcagcgggggcaccggcuccgggacgggcgggagcaccgagaucgugcucacccagucccccggcacccugagccugagccccggggagcgggccacgcucuccugccgcgccagccaguccgugagcuccaacuaccugggcugguaccagcagaagcccggccaggccccgcggcugcucaucuacggggcgagcucccgcgccagcggcauccccgaccgguucuccgggggcgggagcggcaccgacuucacccugaccaucucccgccuggagcccgaggacuucgccgucuacuacugccagcaguacggcagcagcccccucacguucgggggcgggaccaagguggagaucaagcgg

SEQ ID NO: 12820 - RNA, 738 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaucuucaacuccuacgcgaucagcugggugcgccaggccccgggccaggggcucgaguggaugggcggcaucaucgccaucuuccacacccccaaguacgcccagaaguuccaggggcgggugaccaucacggccgacgaguccaccaacaccgcguacauggagcugcgcagccugaaguccgaggacaccgcccucuacuacugcgcccggggcagcacguacgacuucuccagcgggcuggacuacuggggccaggggacccuggucaccguguccagcggcaccggcggguccggcgggacgggcagcggcaccgggggcuccacccaggccgggcucacccagccgcccagcguguccgucgcgcccggccagacggcccgcaucacgugcgggggcaacaacaucggcagcaagagcgugcacugguaccagcagaagcccgggcaggcccccgugcuggucguguacgacgacuccgaccggcccagcggcaucccggagcgcuucuccgggagcaacuccggcaacaccgccacccugaccaucagccggguggaggccggggacgaggcggacuacuacugccaggucugggacuccagcuccgaccacgugguguucggcggcgggaccaagcucaccguccugggc

SEQ ID NO: 12821 - RNA, 741 nt, Artificial Sequence
  derived and/or modified sequence opt1 from anti-influenza_Chain
cagaugcagcuggugcagagcggcgccgaggucaagaagcccggguccagcgugaagguguccugcaaggccagcggcgggaccuucuccagcuacgcgaucaccuggguccgccaggccccgggccaggggcucgaguggaugggcggcaucaucgggauguucggcuccacgaacuacgcccagaacuuccaggggcgggugaccaucaccgccgacgagagcaccuccacggccuacauggagcugagcucccugcgcagcgaggacaccgcgguguacuacugcgcccgguccaccggcuacuaccccgccuaccuccaccacugggggcagggcacccuggucacggugagcuccggcaccgggggcagcgggggcaccggcuccgggaccggcgggagcacgcaguccgcccugacccagccccgcagcgugagcggcucccccgggcagagcgucaccaucuccugcaccggcacgagcuccgacgugggcggguacaacuacgugagcugguaccagcagcacccgggcaaggcgcccaagcucaugaucuacgacgucuccaagcggcccagcggggugcccgaccgcuucuccggcagcaaguccgggaacaccgccagccugaccaucuccggccugcaggccgaggacgaggccgacuacuacugcagcuccuacaccagcuccagcacgcacguguucggcaccgggaccaaggucaccgugcucggc

SEQ ID NO: 12822 - RNA, 744 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcacgggcuccgggaccggcgggagcaccuccuacgugcugacgcagccgcccagcgccuccggcacccccgggcagcgggucaccaucagcugcuccggcagcaccuucaacaucggcagcaacgccguggacugguaccgccagcuccccgggacggcgcccaagcugcugaucuacuccaacaaccagcggcccagcggcgugcccgaccgcuucuccgggagccgguccggcaccagcgccucccucgccaucagcgggcugcaguccgaggacgaggccgacuacuacugcgccgcgugggacgacauccugaacgucccgguguucggcggcgggaccaagcucaccgugcugggc

SEQ ID NO: 12823 - RNA, 744 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcacgggcuccgggaccggcgggagcacccaguccgcccugacgcagcccgccgcggugagcggcucccccgggcagagcaucaccaucuccugcaccggcaccagcagcgacgucggcggguacaacuacguguccugguaccagcagcaccccggcaaggccccgaagcucaugaucuacgaggugagcaaccggcccuccggggucagcaaccgcuucuccggcagcaaguccgggaacacggccagccugaccaucuccggccugcaggccgaggacgaggccgacuacuacugcagcuccuacaccagcuccagcaccuacguguucggcacggggaccaaggugaccguccucggc

SEQ ID NO: 12824 - RNA, 744 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcacgggcuccgggaccggcgggagcaccuccuacgugcugacgcagccgcccagcgucuccggcacccccgggcagcgggugaccaucagcugcuccggcagccgcagcaacgugggcgacaacuccgucuacugguaccagcacgugcccgagauggcccccaagcuccugguguacaagaacacccagcggcccagcgggguccccgcccgcuucuccggcagcaaguccgggacgagcgcgucccuggccaucaucggccuccagagcggggacgaggccgacuacuacugcguggccugggacgacuccguggacggcuacgucuucggcagcgggaccaaggugaccgugcugggc

SEQ ID NO: 12825 - RNA, 744 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcacgggcuccgggaccggcgggagcaccuccuacgugcugacgcagccgcccagcgccuccggcacccccgggcagcgggucaccaucagcugcuccggcagcagcuccaacaucggcagcaacuacguguacugguaccagcagcuccccgggaccgcccccaagcugcugaucuaccgcgacggccagcggcccuccggggugcccgaccgcuucagcggcuccaagagcgggacguccgcgagccucgccaucuccggccugcggagcgacgacgaggccgacuacuacugcgccaccugggacgacaaccuguccggcccggucuucgggggcgggaccaagcucaccgugcugggc

SEQ ID NO: 12826 - RNA, 744 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccuucuacagcauguccugggugcgccaggcgccgggccaggggcucgaguggaugggcggcaucauccccauguucgggaccacgaacuacgcccagaaguuccagggccgggugaccaucaccgccgucgagagcaccuccacggccuacauggaggugagcucccugcgcagcgaggacaccgccguguacuacugcgcgcgcggggacaagggcaucuacuacuacuacauggacgucugggggaagggcaccaccgugacgguguccagcggcaccgggggcuccgggggcaccggcagcgggaccggcggguccacgcagagcgcccugacccagcccgccuccgucagcggcagccccgggcaguccaucaccaucagcugcaccggcacguccagcgacgugggcggguacaacuacguguccugguaccagcagcacccgggcaaggcccccaagcucaugaucuacgaggucagcaaccggcccuccggggugagcaaccgguucuccggcagcaaguccgggaacaccgcgagccugaccaucuccggccugcaggccgaggacgaggccgacuacuacugcagcuccuacaccagcuccagcacgcucguguucggcaccgggaccaaggucaccgugcugggc

SEQ ID NO: 12827 - RNA, 744 nt, Artificial Sequence
  derived and/or modified sequence opt1 from anti-influenza_Chain
augagccuguucggcgacaccaucgccuaccuccugucccugaucgaggacggggagggcaaggccgagcucgcggagaagcugcacugcugguucgggggcaaggaguucgaccuggacagcgcccucgaguggaucaagaacaagcgcugccugaccgacauccagaaggcccugaucggggccuccaucugcuuccucaagcccaaggaccaggagcggaagcgccgguucaucacggagccgcugagcggcaugggcaccaccgccaccaagaagaaggggcugauccucgcggagcgcaagaugcggcgcugcguguccuuccacgaggccuucgagaucgccgagggccacgagagcuccgcccugcuguacugccucauggucauguaccugaaccccgagaacuacagcaugcaggucaagcuggggacgcucugcgcgcugugcgagaagcaggccucccacagccaccgggcccacucccgcgccgcccggagcuccgugcccggcgugcgccgggagaugcagauggugagcgcgaugaacaccgccaagaccaugaacgggaugggcaagggcgaggacgugcagaagcuggccgaggagcuccagaacaacaucgggguccugcgcucccugggcgccagccagaagaacggggagggcaucgccaaggacgugauggaggugcucaagcaguccagcaugggcaacuccgcgcugguccggaaguaccug

SEQ ID NO: 12828 - RNA, 747 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccggcaccgggggcagcgggggcacgggcuccgggaccggcgggagcacccaguccgugcugacgcagccgcccagcgucuccgccgcccccggccagaaggugaccaucagcugcuccgggagcagcuccaacaucggcaacgacuacgugagcugguaccagcagcuccccggcaccgcgcccaagcugcugaucuacgacaacaacaagcggcccuccgggauccccgaccgcuucagcggcuccaagagcgggaccuccgccacgcucggcaucaccgggcugcagaccggcgacgaggccaacuacuacugcgccaccugggaccggcgcccgacggccuacgucguguucggcgggggcaccaagcugaccgugcucggg

SEQ ID NO: 12829 - RNA, 750 nt, Artificial Sequence
  derived and/or modified sequence opt1 from anti-influenza_Chain
caggugcagcugguccagagcggcgccgaggugaagaagcccggguccagcgugcgcgucuccugcaaggccagcggcuccaucuuccggaacuacgcgaugagcugggugcgccaggccccggggcagggccucgaguggaugggcgggaucaucgccaucuucggcacccccaaguacgcccagaaguuccaggggcgggugaccaucacggccgacgaguccaccagcaccgucuacauggagcuguccggccugcgcagcgaggacaccgcgauguacuacugcgcccggaucccccacuacaacuucggguccggcagcuacuucgacuacugggggcagggcacgcucgugaccguguccagcggcaccgggggcuccgggggcaccggcagcgggacgggcggguccaccaccguccugacccagcccccgagcguguccggcgcccccgggcagcgcgugacgaucagcugcaccggcagcuccagcaacaucggcgccggguacgacguccacugguaccagcagcugcccggcaccgcgcccaagcuccugaucuacgggaacuccaaccggccgagcggcgugcccgaccgcuucuccgggagcaaguccggcaccagcgccacgcugggcaucaccgggcuccagaccggcgacgaggccgacuacuacugcgggaccugggacuccagccuguccgccuacguguucggcacggggaccaaggucaccgugcugggc

SEQ ID NO: 12830 - RNA, 756 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggccacaucuucuccggguacgccaucagcugggugcgccaggccccgggccaggggcucgaguggaugggcggcaucauccccaucuucgggaccaccaacuacgcccagaaguuccagggccgggugacgaucaccgccgaccaguccaccagcaccgccuacauggaccuguccaaccugcgcagcgaggacacggcggucuacuacugcgcccgggugaaggacggguacugcacccucaccuccugccccgugggcugguacuucgaccugugggggcgcggcacccuggucacggugagcuccggcaccgggggcagcgggggcaccggcuccgggaccggcgggagcacggagaucgugaugacccagucccccggcacccucagccuguccccgggggagcgggccacccugagcugccgcgccagccaguccgucagcuccagcuaccucgcgugguaccagcagaagcccggccaggcgccccggcugcugaucuucggcgccuccagccgcgccacggggauccccgaccgguucuccggcagcggguccggcaccgacuucacccucaccaucagccgccuggagccggaggacuucgccguguacuacugccagcaguacggguccagccugacguucggcggcgggaccaagcucgagaucaagcgg

SEQ ID NO: 12831 - RNA, 768 nt, Artificial Sequence
  derived and/or modified sequence opt1 from anti-influenza_Chain
caggugcagcugguccagagcggcgccgaggugaagaagcccggguccagcgugaaggucuccugcaaggccagcggcggguucuucuccagcuacgcgaucuccugggugcgccaggcccccggccaggggcucgaguggaugggcggcgugauccccaucuuccggaccgccaacuacgcccagaacuuccaggggcgcgucaccaucacggccgacgaguucaccagcuacauggagcuguccagccugcgguccgacgacaccgcgguguacuacugcgcccgccucaacuaccacgacagcggcaccuacuacaacgcgccccgggggugguucgaccccuggggccaggggacgcuggugaccgucuccagcggcaccggcggguccggcgggaccggcagcggcaccgggggcuccacggacauccagaugacccagagcccggacucccuggccgugagccucggggagaaggccaccaucaacugcaagagcucccagagcauccugaacuccagcaacaacaagaacuaccuggccugguaccagcagaagcccggccagccgcccaagcuccugaucuacugggccuccacgcgcgagagcggggugcccgaccgguucuccggcagcggcuccgggaccgacuucacccugaccaucagcucccuccaggccgaggacgucgccguguacuacugccagcaguacuacagcuccccgcccacguucggccaggggaccaagguggagaucaagcgc

SEQ ID NO: 12832 - RNA, 768 nt, Artificial Sequence; identical to SEQ ID NO: 12831
  derived and/or modified sequence opt1 from anti-influenza_Chain

SEQ ID NO: 12833 - RNA, 771 nt, Artificial Sequence
  derived and/or modified sequence opt1 from anti-influenza_Chain
aucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugcccguaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaag

SEQ ID NO: 12834 - RNA, 771 nt, Artificial Sequence; identical to SEQ ID NO: 12833
  derived and/or modified sequence opt1 from anti-influenza_Chain

SEQ ID NO: 12835 - RNA, 777 nt, Artificial Sequence
  derived and/or modified sequence opt1 from anti-influenza_Chain
auggucaagagcaaguaccugguguucaucuccguguucagccuccuguucggcguguucgucgugggguucucccaccagggcgugaaggccgaggaggagcgccccauggggaccgccuucuacgagagcuucgacgcguucgacgacgagcggugguccaaggccggcgucuggaccaacgggcagauguucaacgccaccugguacccggagcaggucaccgccgacggccugaugcgccucaccaucgccaagaagaccacgagcgcgcggaacuacaaggccggcgagcugcgcaccaacgacuucuaccacuacgggcuguucgagguguccaugaagcccgccaagguggagggcaccgugagcuccuucuucaccuacacgggggagugggacugggacggcgaccccugggacgagaucgacaucgaguuccucgggaaggacaccacccggauccaguucaacuacuucaccaacggcgugggcgggaacgaguucuacuacgaccugggcuucgacgccagcgaguccuucaacacguacgcguucgaguggcgcgaggacagcaucaccugguacgucaacggggaggccgugcacaccgccaccgagaacaucccccagacgccgcagaagaucaugaugaaccuguggcccggcgugggcgucgacggguggaccggcguguucgacggggacaacacccccguguacuccuacuacgacuggguccgguacacgccccuccagaacuaccagauccaccag

SEQ ID NO: 12836 - RNA, 777 nt, Artificial Sequence; identical to SEQ ID NO: 12835
  derived and/or modified sequence opt1 from anti-influenza_Chain

SEQ ID NO: 12837 - RNA, 783 nt, Artificial Sequence
  derived and/or modified sequence opt1 from anti-influenza_Chain
gacauccagaugacccagagccccuccagcguguccgccagcgucggcgaccgcgugaccaucacgugccgggccucccaggacaucagcaccuggcuggcgugguaccagcagaagccggggaaggcccccaagcuccugaucuacgccgccuccagccugcaguccggcgugcccagccgcuucuccgggagcggcuccgggaccgacuucacccucacgaucagcucccugcagcccgaggacuucgccaccuacuucugccagcaggcgaacagcuucccgcccaccuucggcugcggcaccaagcuggagaucaagggcgggggcggguccgggggcggcgggagcggcgggggcggcuccgggggcgggggcagcgagguccagcucguggugagcgggggcggccuggucaagcccgggggcucccugcggcucagcugcgccgccuccgggcugagcuuccugaacgccuggauguccugggugcgccaggcgcccggcaagugccucgaguggguggggcggaucaagagcaacacggacggcggcaccaccgacuacgccgccccggucaaggggcgcuucuccaucagccgggacgacuccaagaacaugcuguuccugcacaugagcucccuccgcaccgaggacacggccguguacuacugcgccaccgacggccccuacagcgacgacuuccgguccggguacgcggcccgcuaccgguacuucggcauggacgugugggggcagggcaccaccgucacggugagcucc

SEQ ID NO: 12838 - RNA, 783 nt, Artificial Sequence; identical to SEQ ID NO: 12837
  derived and/or modified sequence opt1 from anti-influenza_Chain

SEQ ID NO: 12839 - RNA, 789 nt, Artificial Sequence
  derived and/or modified sequence opt1 from anti-influenza_Chain
augggcuucgugcuguucagccagcuccccuccuuccugcuggucagcacccuccugcuguuccucgugaucucccacagcugccgcgcccagaacgggggcuccuacccguacaagagcggggaguaccggaccaaguccuucuucggcuacggguacuacgaggugcgcaugaaggccgcgaagaacgucggcaucgugagcuccuucuucacguacaccggccccagcgacaacaaccccugggacgagaucgacaucgaguuccuggggaaggacaccaccaaggugcaguucaacugguacaagaacggcgucgggggcaacgaguaccugcacaaccucggguucgacgccucccaggacuuccacacguacggcuucgaguggcggcccgacuacaucgacuucuacguggacggcaagaagguguaccgcgggacccggaacaucccggucacccccggcaagaucaugaugaaccuguggcccgggaucggcguggacgaguggcugggccgcuacgacgggcggacgccccuccaggccgaguacgaguacgugaaguacuacccgaacggccgcagcaagcuggucgugaacacccccuucguggccgucuucuccaacuucgacagcucccagugggagaaggccgacugggcgaacgggagcguguucaacugcguguggaagcccucccaggucaccuucagcaacggcaagaugauccugacccucgaccgggaguacguggaccaccaccaccaccaccacaaggacgagcug

SEQ ID NO: 12840 - RNA, 789 nt, Artificial Sequence; identical to SEQ ID NO: 12839
  derived and/or modified sequence opt1 from anti-influenza_Chain

SEQ ID NO: 12841 - RNA, 840 nt, Artificial Sequence
  derived and/or modified sequence opt1 from anti-influenza_Chain
auggcccaggugggccgcggggccagcccccugucccgggcgcgcgucccgccccucccccacccccuggacggcgagcaccucccgcacgaccccgccgggggcgggcacggcaaggccagcucccaggacgcccccgugggccagcuccccgggcaccuggcccggccggcguucuuccacuaccugaagaacagcuuccucgugugcucccugaccaccgucuucgcccuggccguggccacguucgcgggcuacgcccucgcccgcuuccgguuccccggggccgagcuguucggcgggagcgugcuggucacccaggugauccccggcauccucuuccugauccccaucuacaucauguacaucuacgugcagaacuggguccgcuccgcccugggccucgaggugcggcugguggggagcuacggcgggcuggucuucaccuacaccgcguucuucgugccgcucuccaucuggauccugcgcggcuucuucgccagcauccccaaggagcuggaggaggccgccaugguggacggcgccacgcccuuccaggcguuccaccgggucauccucccccuggcccugccggggcucgccgccaccgccguguacaucuuccugaccgcgugggacgagcugcuguucgcccaggugcugaccacggaggccaccgccaccguccccgugggcauccgcaacuucguggggaacuaccagaaccgguacgaccuggucauggccgcggccaccguggccacgcuccccgugcugguccuguucuucuucgugcagcgccagcucauccagggccugaccgccggggcggucaagggc

SEQ ID NO: 12842 - RNA, 840 nt, Artificial Sequence; identical to SEQ ID NO: 12841
  derived and/or modified sequence opt1 from anti-influenza_Chain

SEQ ID NO: 12843 - RNA, 843 nt, Artificial Sequence
  derived and/or modified sequence opt1 from anti-influenza_Chain
auggccgacaacaugaccaccacgcagaucgaggugggccccggggccaccaacgcgaccaucaacuucgaggccggcauccuggagugcuacgagcgcuucagcuggcagcgggcccucgacuacccggggcaggaccgccugcaccggcugaagcgcaagcucgagucccggaucaagacccacaacaagagcgagcccgagaacaagcgcaugucccuggaggagcggaaggccaucggcgucaagaugaugaaggugcuccuguucauggaccccagcgccgggaucgagggcuucgagcccuacugcgugaagaacccguccacgagcaagugccccaacuacgacuggaccgacuacccgcccacccccggcaaguaccuggacgacaucgaggaggagcccgagaacgucgaccaccccaucgagguggugcugcgcgacaugaacaacaaggacgcgcggcagaagaucaaggacgaggucaacacccagaaggaggggaaguuccgccucacgaucaagcgggacauccgcaacgugcugucccugcgggugcucgucaacggcaccuuccugaagcaccccaacggggacaagagccuguccacccuccaccgccugaacgccuacgaccagaacggcgggcugguggccaagcucguggccaccgacgaccggacggucgaggacgagaaggacggccaccgcauccugaacagccuguucgagcgguucgacgagggccacuccaagccgauccgcgcggccgagaccgccgugggggugcucagccaguucggccaggagcaccggcugucccccgaggagggggacaac

SEQ ID NO: 12844 - RNA, 843 nt, Artificial Sequence; identical to SEQ ID NO: 12843
  derived and/or modified sequence opt1 from anti-influenza_Chain

SEQ ID NO: 12845 - RNA, 858 nt, Artificial Sequence
  derived and/or modified sequence opt1 from anti-influenza_Chain
augugcaccaugccccugaugaagcucaagaagaugaugcgccggaccgccuuccugcugagcgugcucaucggcugcuccaugcuggggagcgaccgcuccgacaaggccccgcacugggagcuggucuggagcgacgaguucgacuacuccggccuccccgaccccgagaagugggacuacgacgucgggggccacggguggggcaaccaggagcugcaguacuacacgcgggcgcgcaucgagaacgcccgggugggcgggggcgugcugaucaucgaggcccgccacgagcccuacgaggggcgggaguacaccagcgcccgccucgugacccggggcaaggccuccuggaccuacgggcgcuucgagauccgggcgcgccugccgagcggccggggcacguggcccgccaucuggaugcugcccgaccgccagaccuacggguccgccuacuggcccgacaacggcgagaucgacaucauggagcacgugggguucaacccggacgucgugcacggcaccgugcacaccaaggccuacaaccaccuccugggcacgcagcgcgggggcagcauccggguccccaccgcgcggaccgacuuccacguguacgccaucgaguggacccccgaggagauccgcugguucguggacgacucccuguacuaccgguuccccaacgagcgccucacggacccggaggccgacuggcggcacuggcccuucgaccagcccuuccaccugaucaugaacaucgccgucgggggcgccuggggcgggcagcagggcguggaccccgaggcguucccggcccagcugguggucgacuacgugcgcguguaccgcugggucgag

SEQ ID NO: 12846 - RNA, 858 nt, Artificial Sequence; identical to SEQ ID NO: 12845
  derived and/or modified sequence opt1 from anti-influenza_Chain

SEQ ID NO: 12847 - RNA, 900 nt, Artificial Sequence
  derived and/or modified sequence opt1 from anti-influenza_Chain
aacgugcccgaguggagcuacaucgucgagaaggccaacccggccaacgaccugugcuaccccggcaacuucaacgacuacgaggagcucaagcaccuccugucccgcaucaaccacuucgagaagauccagggguacauccccgaggcgccccgggacggccaggccuacgugcgcaaggacggggagugggugcuccugagcaccuuccugcgguccgacaagacccacacgugcccgcccugccccgcccccgagcuccugggcgggccgagcgucuuccuguucccgcccaagcccaaggacacccucaugaucucccgcacccccgaggugaccugcguggucguggacgugagccacgaggaccccgaggucaaguucaacugguacguggacggcguggagguccacaacgccaagacgaagccccgggaggagcaguacaacuccaccuaccgcguggugagcguccugaccgugcugcaccaggacuggcucaacggcaaggaguacaagugcaagguguccaacaaggcccugcccgcgccgaucgagaagaccaucagcaaggccaaggggcagccccgggagccccaggucuacacgcugcccccgucccgcgaggagaugaccaagaaccaggugagccugaccugccuggugaagggcuucuaccccuccgacaucgccgucgagugggagagcaacgggcagcccgagaacaacuacaagaccacgcccccggugcuggacuccgacggcagcuucuuccucuacuccaagcugaccguggacaagagccgguggcagcaggggaacgucuucuccugcagcgugaugcacgaggcccugcacaaccacuacacccagaagucccucagccugagccccggcaag

SEQ ID NO: 12848 - RNA, 900 nt, Artificial Sequence; identical to SEQ ID NO: 12847
  derived and/or modified sequence opt1 from anti-influenza_Chain

SEQ ID NO: 12849 - RNA, 927 nt, Artificial Sequence
  derived and/or modified sequence opt1 from anti-influenza_Chain
auggugaaccgccgggaccugaucaaguggagcgccgucgcccucggcgcgggggccggccuggccgggcccgccccggccgcgcacgccgccgaccuggagugggagcaguaccccgugcccgccgcgcccggcgggaaccgcuccuggcagcuccugccgagccacuccgacgacuucaacuacaccggcaagccccagaccuuccggggccgcuggcuggaccagcacaaggacggguggagcggccccgccaacucccucuacagcgcccggcacuccuggguggccgacgggaaccugaucgucgagggccgccgggcccccgacgggcgcguguacugcggcuacgugacgagccggaccccggucgaguacccccuguacaccgaggugcucaugcgcguguccggccugaagcugagcuccaacuucuggcuccugagccgggacgacgucaacgagaucgacgugaucgagugcuacgggaacgagucccugcacggcaagcacaugaacaccgcguaccacaucuuccagcgcaaccccuucacggagcucgcccggagccagaagggguacuucgccgacggcuccuacggcuacaacggggagaccggccagguguucggggacggcgccgggcagccccugcugcgcaacggcuuccaccgguacggcguccacuggaucagcgccaccgaguucgacuucuacuucaacgggcgccucgugcggcgccugaaccgguccaacgaccugcgcgacccgcggagccgcuucuucgaccagcccaugcaccucauccugaacaccgagucccaccaguggcgcguggaccggggcaucgagcccacggacgcggagcuggccgaccccagcaucaacaacaucuacuaccgcuggguccggaccuaccaggccgug

SEQ ID NO: 12850 - RNA, 927 nt, Artificial Sequence; identical to SEQ ID NO: 12849
  derived and/or modified sequence opt1 from anti-influenza_Chain

SEQ ID NO: 12851 - RNA, 960 nt, Artificial Sequence
  derived and/or modified sequence opt1 from anti-influenza_Chain
aucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugcccguaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaagggcgacagcgccaucgugaaguccgagguggaguacggcaacugcaacaccaagugccagaccccgaucggggccaucaacagcagcaugcccuuccacaacauccacccccucacgaucggcgagugccccaaguacgucaaguccaacaagcuggugcuggccaccgggcuccggaacagcccgcug

SEQ ID NO: 12852 - RNA, 960 nt, Artificial Sequence; identical to SEQ ID NO: 12851
  derived and/or modified sequence opt1 from anti-influenza_Chain

SEQ ID NO: 12853 - RNA, 960 nt, Artificial Sequence; identical to SEQ ID NO: 12851
  derived and/or modified sequence opt1 from anti-influenza_Chain

SEQ ID NO: 12854 - RNA, 978 nt, Artificial Sequence
  derived and/or modified sequence opt1 from anti-influenza_Chain
acccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugacggccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcaccucccgguacagcaagaaguucaagcccgagaucgcgauccgcccgaaggugcgggaccaggagggccgcaugaacuacuacuggacccugguggagcccggggacaagaucacguucgaggccaccggcaaccucgucgugccccgguacgccuucgccauggagcgcgacgccggguccggcaucaucaucagcgacacccccgugcacgacugcaacaccacgugccagaccccgaagggcgcgaucaacaccucccugcccuuccagaacauccaccccaucaccaucgggaagugccccaaguacgucaagagcacgaagcugcggcucgccaccggccugcgcaacgugccguccauccagagccgg

SEQ ID NO: 12855 - RNA, 978 nt, Artificial Sequence; identical to SEQ ID NO: 12854
  derived and/or modified sequence opt1 from anti-influenza_Chain

SEQ ID NO: 12856 - RNA, 960 nt, Artificial Sequence; identical to SEQ ID NO: 12851
  derived and/or modified sequence opt1 from anti-influenza_Chain

SEQ ID NO: 12857 - RNA, 990 nt, Artificial Sequence
  derived and/or modified sequence opt1 from anti-influenza_Chain
augugcagcuccauccccagccugcgcgagguguucgccaacgacuuccggaucggcgccgcggucaacccggugacccucgaggcccagcagucccugcugauccgccacgugaacagccucaccgccgagaaccacaugaaguucgagcaccuccagcccgaggaggggcgguucacguucgacaucgccaucaaguccagcaccucccccuucagcucccacggcguccgcgggcacacccugguguggcacaaccagacccccagcuggguguuccaggacucccagggccacuucgucgggcgggacgugcugcuggagcgcaugaagucccacaucagcacggugguccagcgguacaagggcaagguguacugcugggacgugaucaacgaggccgucgcggacgagggcagcgaguggcugcgcuccagcaccuggcggcagaucaucggggacgacuucauccagcaggccuuccucuacgcccacgaggccgacccggaggcgcugcuguucuacaacgacuacaacgagugcuuccccgagaagcgcgagaagaucuacacccucgugaagucccugcgggacaagggcauccccauccacgggaucggcaugcaggcccacuggagccugaaccgccccacccucgacgagauccgggccgccaucgagcgcuacgccucccugggggugauccugcacaucacggagcucgacaucagcauguucgaguucgacgaccaccggaaggaccuggcggccccgaccaacgagauggucgagcgccaggccgagcgguacgagcagaucuucagccuguucaaggaguaccgcgacgugauccagaacgugaccuucuggggcaucgccgacgaccacaccuggcucgaccacuuccccguccagggccggaagaacuggccccugcuguucgacgagcagcacaaccccaagccggccuucuggcgcguggugaacauc

SEQ ID NO: 12858 - RNA, 990 nt, Artificial Sequence; identical to SEQ ID NO: 12857
  derived and/or modified sequence opt1 from anti-influenza_Chain

SEQ ID NO: 12859 - RNA, 1002 nt, Artificial Sequence
  derived and/or modified sequence opt1 from anti-influenza_Chain
augaagaaccgcgugaucagccugcucauggccucccugcugcucguccugagcgugaucguggcccccuucuacaaggcggaggccgccaccgucgugaacaccccguucguggccgucuucuccaacuucgacagcucccagugggagaaggccgacugggcgaacggcagcguguucaacugcguguggaagcccucccaggucacguucagcaacgggaagaugauccugacccucgaccgggaguacggcggguccuaccccuacaagagcggcgaguaccgcaccaaguccuucuucggguacggcuacuacgaggugcggaugaaggccgccaagaacgugggcaucgucagcuccuucuucaccuacacggggcccagcgacaacaacccgugggacgagaucgacaucgaguuccugggcaaggacaccaccaaggugcaguucaacugguacaagaacggggugggcgggaacgaguaccugcacaaccucggcuucgacgccucccaggacuuccacaccuacggcuucgaguggcgccccgacuacaucgacuucuacgucgacgggaagaagguguaccggggcacgcgcaacauccccgugacccccgggaagaucaugaugaaccuguggccgggcaucggcgucgacgaguggcuggggcgguacgacggccgcacgccccuccaggcggaguacgaguacgugaaguacuaccccaacggggugccccaggacaacccgacccccacccccaccaucgcccccagcaccccgaccaaccccaaccugccccugaagggcgacgucaacggggacggccacgugaacuccagcgacuacucccucuucaagcgguaccugcugcgcgugaucgaccgguuccccgucggcgaccagagcguggccgacgucaaccgcgacgggcggaucgacagcacggaccucaccaugcugaagcgcuaccugauccgggccaucccgucccuc

SEQ ID NO: 12860 - RNA, 1002 nt, Artificial Sequence; identical to SEQ ID NO: 12859
  derived and/or modified sequence opt1 from anti-influenza_Chain

SEQ ID NO: 12861 - RNA, 1041 nt, Artificial Sequence
  derived and/or modified sequence opt1 from anti-influenza_Chain
aucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugcccguaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaagggcgacagcgccaucgugaaguccgagguggaguacggcaacugcaacaccaagugccagaccccgaucggggccaucaacagcagcaugcccuuccacaacauccacccccucacgaucggcgagugccccaaguacgucaaguccaacaagcuggugcuggccaccgggcuccggaacagcccgcugggcuacauccccgaggcgccccgcgacggccaggccuacgugcggaaggacggggaguggguccugcucuccaccuuccug

SEQ ID NO: 12862 - RNA, 1041 nt, Artificial Sequence; identical to SEQ ID NO: 12861
  derived and/or modified sequence opt1 from anti-influenza_Chain

SEQ ID NO: 12863 - RNA, 1047 nt, Artificial Sequence
  derived and/or modified sequence opt1 from anti-influenza_Chain
augaacaucaagaagaccgccgucaagagcgcccuggcgguggccgccgccgccgcggcccucaccacgaacguguccgccaaggacuucagcggcgccgagcuguacacccuggaggaggugcaguacgggaaguucgaggcgcgcaugaagauggccgccgccuccggcaccgucagcuccauguuccucuaccagaacgggagcgagaucgccgacggccggcccuggguggagguggacaucgagguccuggggaagaacccgggcuccuuccagagcaacaucaucaccggcaaggcgggggcccagaagacguccgagaagcaccacgccgugagccccgccgccgaccaggcguuccacaccuacggccuggaguggacccccaacuacgugcgcuggaccgucgacgggcaggaggugcggaagacggagggcggccagguguccaaccucaccgggacccagggccugcgcuucaaccuguggagcuccgagagcgccgccugggucgggcaguucgacgaguccaagcucccccuguuccaguucaucaacugggugaagguguacaaguacaccccgggccagggggagggcggcagcgacuucacgcuggacuggaccgacaacuucgacaccuucgacgggucccgguggggcaagggggacuggaccuucgacggcaaccgcgucgaccucacggacaagaacaucuacagccgggacgggaugcugauccuggcccucacccgcaagggccaggaguccuucaacggccaggugccccgggacgacgagcccgcgccccagagcagcuccagcgccccggccuccagcuccagcgugcccgccuccagcuccagcguccccgccuccagcuccagcgccuucgugcccccguccagcuccagcgcgaccaacgccauccacgggaugcgcaccacgcccgccguggccaaggagcaccggaaccuggucaacgcgaagggcgccaaggugaaccccaacgggcacaagcgcuaccgggugaacuucgagcac

SEQ ID NO: 12864 - RNA, 1047 nt, Artificial Sequence
  derived and/or modified sequence opt1 from anti-influenza_Chain
gaggugcagcuggucgagagcggcgggggcguggugcagcccgggcgcucccuccggcugagcugcgccgccuccggcuucgcguuccacaaccgcgccaugcacuggguccggcaggccccggggaagggccuggaguggguggcccucaucuacuucgacggcagcaagcaguacuacgccgacuccgugaaggggcgcuucaccaucagccgggacaacuccaagaacaccgucuuccugcagaugaacagccugcgccccgaggacacggcgguguacuacugcgccgugcccggccccaucuucgggaucuucccgcccugguccuacuucgaccacuggggccaggggauccucgucaccgugagcuccgccagcaccaagggccccuccguguucccccuggccccgagcuccaagagcaccuccggcgggacggcggcccugggcugccucgucaaggacuacuuccccgagcccgugaccgugagcuggaacuccggggcccugaccagcggcguccacaccuuccccgccgugcugcagagcuccggccucuacagccuguccagcguggucacggugccguccagcucccuggggacccagaccuacaucugcaacgugaaccacaagcccagcaacaccaaggucgacaagaagguggagcccaaguccugcgacaagacgcacacgugcccgcccugccccgcccccgagcuccugggcgggcccagcguguuccuguucccgcccaagcccaaggacacccucaugaucucccggacccccgaggugaccugcgucgucguggacgugagccacgaggacccggaggucaaguucaacugguacguggacggcguggagguccacaacgcgaagaccaagccccgcgaggagcaguacaacuccaccuaccggguggugagcguccugaccgugcugcaccaggacuggcucaacgggaaggaguacaagugcaagguguccaacaaggcccugcccgcccccaucgagaagacgaucagcaaggccaagggc

SEQ ID NO: 12865 - RNA, 1047 nt, Artificial Sequence; identical to SEQ ID NO: 12864
  derived and/or modified sequence opt1 from anti-influenza_Chain

SEQ ID NO: 12866 - RNA, 1047 nt, Artificial Sequence; identical to SEQ ID NO: 12863
  derived and/or modified sequence opt1 from anti-influenza_Chain

SEQ ID NO: 12867 - RNA, 1161 nt, Artificial Sequence
  derived and/or modified sequence opt1 from anti-influenza_Chain
augaacaaguuccugaacaagaaguggagccucauccugaccaugggcgggaucuuccugauggccacccucucccugaucuucgccacgggcaagaaggcguucaacgaccagaccagcgccgaggacauccccucccuggccgaggccuuccgcgacuacuucccgaucggggccgcgaucgagcccggcuacaccaccgggcagaucgccgagcucuacaagaagcacgugaacaugcuggucgccgagaacgccaugaagcccgcgagccugcagcccacggagggcaacuuccagugggccgacgccgaccggaucgugcaguucgccaaggagaacggcauggagcuccgcuuccacacccugguguggcacaaccagaccccgaccggguucucccuggacaaggagggcaagcccauggucgaggagacggacccccagaagcgggaggagaaccgcaagcuccugcugcagcggcucgagaacuacauccgcgccguggugcugcgguacaaggacgacaucaagagcugggacgucgugaacgaggugaucgagcccaacgaccccgggggcaugcgcaacuccccgugguaccagaucaccgggaccgaguacaucgaggucgcguuccgggccacccgcgaggccggcggcagcgacaucaagcuguacaucaacgacuacaacacggacgaccccgugaagcgggacauccucuacgagcuggugaagaaccugcucgagaaggggguccccaucgacggcguggggcaccagacccacaucgacaucuacaacccgcccguggagcgcaucaucgaguccaucaagaaguucgccggccugggccuggacaacaucaucaccgagcucgacaugagcaucuacuccuggaacgaccggagcgacuacggggacuccauccccgacuacauccugacccugcaggccaagcgcuaccaggagcuguucgacgcgcucaaggagaacaaggacaucgucagcgccgugguguucuggggcaucuccgacaaguacagcuggcugaacggguuccccgucaagcggacgaacgccccgcuccuguucgaccgcaacuucaugcccaagcccgccuucugggccaucguggaccccucccggcugcgcgag

SEQ ID NO: 12868 - RNA, 1161 nt, Artificial Sequence; identical to SEQ ID NO: 12867
  derived and/or modified sequence opt1 from anti-influenza_Chain

SEQ ID NO: 12869 - RNA, 1221 nt, Artificial Sequence
  derived and/or modified sequence opt1 from anti-influenza_Chain
augcgcaacgugguccggaagccccugaccaucggccucgcccugacccugcuccugccgauggggaugacggccaccagcgcgaagaacgccgacuccuacgccaagaagccccacaucagcgcccugaacgcgccccagcucgaccagcgcuacaagaacgaguucaccaucggcgccgccguggagcccuaccagcugcagaacgagaaggacgugcagaugcugaagcggcacuucaacuccaucgucgccgagaacgugaugaagccgaucagcauccagcccgaggaggggaaguucaacuucgagcaggccgaccgcaucgugaaguucgcgaaggccaacggcauggacauccgguuccacacccucgucuggcacucccaggugccccagugguucuuccuggacaaggaggggaagcccauggugaacgagacggacccggucaagcgcgagcagaacaagcagcugcuccugaagcggcuggagacccacaucaagaccaucguggagcgcuacaaggacgacaucaaguacugggacguggucaacgagguggugggcgacgacggcaagcuccggaacagccccugguaccagaucgccgggaucgacuacaucaaggucgccuuccaggccgcgcgcaaguacggcggggacaacaucaagcuguacaugaacgacuacaacaccgagguggagcccaagcggacggcccuguacaaccucgugaagcagcugaaggaggagggcguccccaucgacgggaucggccaccagucccacauccagaucggcuggccgagcgaggccgagaucgagaagaccaucaacauguucgccgcccuggggcucgacaaccagaucaccgagcuggacguguccauguacggcuggccgccccgcgcguaccccaccuacgacgccauccccaagcagaaguuccuggaccaggccgcccgguacgaccgccucuucaagcuguacgagaagcugagcgacaagaucuccaacgugacguucugggggaucgccgacaaccacaccuggcucgacagccgggcggacgucuacuacgacgccaacggcaacgugguggucgaccccaacgcccccuacgccaagguggagaagggcaaggggaaggacgcccccuucgucuucggcccggacuacaaggugaagcccgcguacugggccaucaucgaccacaag

SEQ ID NO: 12870 - RNA, 1221 nt, Artificial Sequence; identical to SEQ ID NO: 12869
  derived and/or modified sequence opt1 from anti-influenza_Chain

SEQ ID NO: 12871 - RNA, 1233 nt, Artificial Sequence
  derived and/or modified sequence opt1 from anti-influenza_Chain
cugagccgcaucaaccacuucgagaagauccagaucauccccaaguccagcugguccgaccacgaggccagcuccggcgugagcuccgccugcccguaccaggggacccccagcuucuuccggaacgucguguggcucaucaagaagaacaacaccuaccccacgaucaagcgcuccuacaacaacaccaaccaggaggaccugcugauccucuggggcauccaccacagcaacgacgcggccgagcagaccaagcuguaccagaaccccaccacguacaucuccguggggaccagcacccugaaccagcggcucgucccgaagaucgccacccgcuccaaggugaacggccagaacgggcggauggacuucuucuggacgauccugaagcccaacgacgccaucaacuucgagagcaacggcaacuucaucgcccccgaguacgcguacaagaucgugaagaagggcuacauccccgaggccccgcgcgacgggcaggccuacguccggaaggacggcgagugggugcugcucuccaccuuccugcgcagcgacaagacccacacgugcccgcccugccccgcccccgagcugcucgggggccccuccguguuccuguucccgcccaagcccaaggacacccugaugaucagccggacccccgaggugaccugcgucguggucgacgugucccacgaggaccccgaggugaaguucaacugguacgucgacgggguggaggugcacaacgcgaagaccaagccccgcgaggagcaguacaacagcacguaccgggucgugagcgugcucaccguccugcaccaggacuggcugaacggcaaggaguacaagugcaagguguccaacaaggcccucccggcccccaucgagaagaccaucagcaaggccaagggccagccccgcgagccccagguguacacccugccgcccucccgggaggagaugacgaagaaccaggucagccugaccugccucgugaagggguucuaccccuccgacaucgccgucgagugggagagcaacggccagcccgagaacaacuacaagaccaccccgcccgugcuggacuccgacgggagcuucuuccuguacuccaagcucacgguggacaagagccgcuggcagcagggcaacgucuucuccugcagcgugaugcacgaggcgcugcacaaccacuacacccagaagucccugagccucucccccggcaag

SEQ ID NO: 12872 - RNA, 1233 nt, Artificial Sequence; identical to SEQ ID NO: 12871
  derived and/or modified sequence opt1 from anti-influenza_Chain

SEQ ID NO: 12873 - RNA, 1293 nt, Artificial Sequence
  derived and/or modified sequence opt1 from anti-influenza_Chain
auggacgaccacgccgagaaguuccuguggggcguggccaccagcgcguaccagaucgagggggccacccaggaggacggccgcgggcccuccaucugggacgccuucgcccggcgcccgggcgccauccgggacgggagcacgggcgagcccgcgugcgaccacuaccgccgguacgaggaggacaucgcccucaugcagucccugggcguccgcgccuaccgguucagcguggccuggccccgcauccugcccgaggggcggggccgcaucaacccgaaggggcucgcguucuacgaccggcugguggaccgccugcucgccuccggcaucacccccuuccugacccuguaccacugggaccucccccuggcccuggaggagcgcgggggcuggcggagccgggagaccgccuucgccuucgcggaguacgccgaggccgucgcccgcgcccucgcggaccgggugcccuucuucgccacgcugaacgagccguggugcuccgccuuccugggccacuggaccggggagcacgcccccggccuccgcaaccuggaggccgcgcugcgggccgcccaccaccuccugcuggggcacggccucgccguggaggcccugcgcgcggccggcgcccggcgcgucgggaucgugcugaacuucgcccccgcguacggcgaggaccccgaggccguggacgucgccgaccgcuaccacaaccgguacuuccucgacccgauccuggggaagggcuaccccgagagccccuuccgcgacccgccgcccgugcccauccugucccgggaccucgagcugguggcccgcccccuggacuuccucggggucaacuacuacgcccccgugcggguggcgcccggcaccggcacccugcccguccgcuaccugcccccggaggggcccgccacggccaugggcugggagguguaccccgaggggcuccaccaccuccugaagcggcugggccgcgaggugcccuggccgcuguacgucaccgagaacggggccgccuaccccgaccuguggaccggcgaggcggugguggaggaccccgagcgggucgccuaccucgaggcccacguggaggccgcccugcgcgcgcgggaggagggcguggaccugcgcggguacuucgucuggagccucauggacaacuucgagugggccuucggcuacacccggcgcuucgggcuguacuacguggacuucccgucccagcggcgcauccccaagcggagcgcccugugguaccgcgagcggaucgcccgcgcgcagacg

SEQ ID NO: 12874 - RNA, 1293 nt, Artificial Sequence
  derived and/or modified sequence opt1 from anti-influenza_Chain
augaccgagaacgccgagaaguuccuguggggcguggccaccagcgcguaccagaucgagggggccacgcaggaggacggccgcgggcccuccaucugggacgccuucgcccagcggccgggcgccauccgcgacgggagcaccggcgagcccgcgugcgaccacuaccggcgcuacgaggaggacaucgcccucaugcagucccugggcguccgggccuaccgcuucagcguggccuggccccggauccugcccgaggggcgcggccggaucaacccgaaggggcucgcguucuacgaccgccugguggaccggcugcucgccuccggcaucacccccuuccugacccuguaccacugggaccucccccuggcccuggaggagcgcgggggcuggcggagccgcgagacggccuucgccuucgcggaguacgccgaggccgucgcccgggcccucgcggaccgcgugcccuucuucgccacccugaacgagccguggugcuccgccuuccugggccacuggaccggggagcacgcccccggccuccggaaccuggaggccgcgcugcgcgccgcccaccaccuccugcuggggcacggccucgccguggaggcccugcgggcggccggcgcccgccgggucgggaucgugcugaacuucgcccccgcguacggcgaggaccccgaggccguggacgucgccgaccgcuaccacaaccgcuucuuccucgacccgauccuggggaagggcuaccccgagagccccuuccgggacccgccgcccgugcccauccugucccgcgaccucgagcugguggcccggccccuggacuuccucggggucaacuacuacgcccccgugcgcguggcgcccggcaccggcacgcugcccguccgguaccugcccccggaggggcccgccaccgccaugggcugggagguguaccccgaggggcucuaccaccuccugaagcgccugggccgggaggugcccuggccgcuguacgucaccgagaacggggccgccuaccccgaccuguggaccggcgaggcggugguggaggaccccgagcgcgucgccuaccucgaggcccacguggaggccgcccugcgggcgcgcgaggagggcguggaccugcggggguacuucgucuggagccucauggacaacuucgagugggccuucggcuacacgcgccgguucgggcuguacuacguggacuucccgucccagcgccggauccccaagcgcagcgcccugugguaccgggagcgcaucgcccgggcgcagacc

SEQ ID NO: 12875 - RNA, 1293 nt, Artificial Sequence
  derived and/or modified sequence opt1 from anti-influenza_Chain
auggccgagaacgccgagaaguuccuguggggcguggcgaccagcgccuaccagaucgagggggccacccaggaggacggccgcgggcccuccaucugggacacguucgcccggcgcccgggcgccauccgggacgggagcaccggcgagcccgcgugcgaccacuaccaccgcuacgaggaggacaucgcccucaugcagucccugggcgucgggguguaccgguucagcguggccuggccccgcauccugcccgagggccgggggcgcaucaacccgaagggccucgccuucuacgaccggcuggucgaccgccugcucgcggccgggaucacccccuuccugacccuguaccacugggaccucccccaggcccuggaggaccggggcggcuggcgcucccgggagacggccuucgccuucgcggaguacgccgaggccguggcccgcgcccuggcggaccgggugcccuucuucgccacccucaacgagccguggugcagcgccuuccuggggcacuggaccggcgagcacgcccccgggcugcgcaaccucgaggccgcgcugcgggccgcccaccaccuccugcugggccacggccuggccgucgaggcccuccgcgcggccggggccaagcgggugggcaucgugcugaacuucgcccccgucuacggggaggaccccgaggcgguggacguggccgaccgcuaccacaaccgguacuuccuggacccgauccucggccgcggguaccccgagucccccuuccaggacccgccgcccacccccaaccugagccgcgaccuggagcucgucgcccggccccuggacuuccugggcgugaacuacuacgcccccgugcgcgucgcccccggcacggggccccuccccgugcgguaccugccgcccgagggccccgugaccgcgauggggugggaggucuaccccgagggccuguaccaccuccugaagcgccuggggcgggaggugccguggccccucuacaucaccgagaacggcgccgccuaccccgaccuguggaccggcgaggccguggucgaggacccggagcgcguggccuaccuggaggcgcacguggaggccgcccuccgggcccgcgaggagggggucgaccugcggggcuacuucguguggucccugauggacaacuucgagugggccuucggguacacgcgccgguucggccucuacuacgucgacuuccccagccagcgccggauccccaagcgcuccgcgcugugguaccgggagcgcaucgcccgggcccagcug

SEQ ID NO: 12876 - RNA, 1293 nt, Artificial Sequence; identical to SEQ ID NO: 12873
  derived and/or modified sequence opt1 from anti-influenza_Chain

SEQ ID NO: 12877 - RNA, 1293 nt, Artificial Sequence; identical to SEQ ID NO: 12874
  derived and/or modified sequence opt1 from anti-influenza_Chain

SEQ ID NO: 12878 - RNA, 1293 nt, Artificial Sequence; identical to SEQ ID NO: 12875
  derived and/or modified sequence opt1 from anti-influenza_Chain

SEQ ID NO: 12879 - RNA, 1296 nt, Artificial Sequence
  derived and/or modified sequence opt1 from anti-influenza_Chain
auguucaagcccaacuaccacuucuucccgaucaccggcuggaugaacgaccccaacgggcugaucuucuggaagggcaaguaccacauguucuaccaguacaacccccgcaagcccgagugggggaacaucugcuggggccacgccgugagcgacgaccucguccacuggcggcaccucccgguggcccuguaccccgacgacgagacccacgggguguucuccggcagcgcggucgagaaggacggcaagauguuccugguguacacguacuaccgcgaccccacccacaacaagggggagaaggagacccagugcguggccauguccgagaacggccuggacuucgucaaguacgacgggaaccccgugaucagcaagccgcccgaggagggcacccacgccuuccgggaccccaaggugaaccgcuccaacggggaguggcggaugguccugggcagcggcaaggacgagaagaucgggcgcgugcuccuguacacguccgacgaccuguuccacuggaaguacgagggcgugaucuucgaggacgagaccaccaaggagaucgagugccccgaccucguccggaucggggagaaggacauccugaucuacagcaucaccuccacgaacagcgugcuguucuccaugggcgagcucaaggagggcaagcugaacguggagaagcgcgggcugcucgaccacggcaccgacuucuacgccgcccagaccuucuucgggaccgaccgggucguggugaucggcuggcugcagagcuggcugcgcacggggcucuacccgaccaagcgggagggcuggaacggcgucaugucccugccccgcgagcuguacguggagaacaacgagcucaaggugaagcccgucgacgagcugcuggcgcuccggaagcgcaagguguucgagaccgccaagagcgggaccuuccugcuggacgugaaggagaacuccuacgagaucgucugcgaguucagcggcgagaucgagcuccggauggggaacgaguccgaggagguggucaucaccaagagccgcgacgagcugaucguggacacgacccgguccggcgugagcgggggcgagguccgcaagagcaccguggaggacgaggccacgaaccggauccgcgccuuccuggacuccugcagcguggaguucuucuucaacgacuccaucgcguucagcuuccggauccaccccgagaacgucuacaacauccucuccgucaagagcaaccaggugaagcuggagguguucgagcuggagaacaucuggcuc

SEQ ID NO: 12880 - RNA, 1296 nt, Artificial Sequence; identical to SEQ ID NO: 12879
  derived and/or modified sequence opt1 from anti-influenza_Chain

SEQ ID NO: 12881 - RNA, 1323 nt, Artificial Sequence
  derived and/or modified sequence opt1 from anti-influenza_Chain
gaggugaagcuggucgagagcggcgggggccucgugcagcccgggggcucccugcgccugagcugcgccaccuccggguucaccuucagcgacuacuacauguccugggugcggcagagcccgggcaaggcccucgaguggcugggcuucacccgcucccggguccugggguacaccaccgacuacagcgcguccgugaagggccgcuucaccaucagccgggacaacucccagagcauccucuaccugcagaugaacucccugcgcggggaggacagcgccacguacuacugcgcccgggaccgccccauggacuacuggggccaggggaccuccgugaccgucagcuccgccaagaccacgccgcccagcguguacccccucgcccccggcuccgcggcccagaccaacagcauggugacccugggcugccuggucaagggguacuuccccgagcccgugaccgugacguggaacagcggcucccucagcuccgggguccacaccuucccggccgugcugcagagcgaccuguacacccucuccagcuccgugaccguccccagcuccacguggcccagcgagaccgugaccugcaacguggcccaccccgcguccagcaccaaggucgacaagaagaucgugccgcgggacugcggcugcaagcccugcaucugcacggugcccgaggucuccagcguguucaucuucccgcccaagcccaaggacgugcugaccaucacccugacccccaaggucacgugcguggucguggacaucuccaaggacgaccccgaggugcaguucagcugguucgucgacgacguggaggugcacaccgcccagacccagccgcgcgaggagcaguucaacuccaccuuccggagcgucuccgagcuccccaucaugcaccaggacuggcugaacggcaaggaguucaagugccgcgugaacagcgccgccuuccccgcccccaucgagaagacgaucagcaagaccaaggggcggccgaaggcgccccagguguacaccaucccgccgcccaaggagcagauggccaaggacaaggucucccugaccugcaugaucacggacuucuuccccgaggacaucaccguggaguggcaguggaacggccagcccgccgagaacuacaagaacacccagcccaucauggacaccgacgggagcuacuucguguacuccaagcucaacguccagaaguccaacugggaggccggcaacacguucacgugcagcgugcugcacgaggggcugcacaaccaccacaccgagaagucccucagccacagccccggcaag

SEQ ID NO: 12882 - RNA, 1323 nt, Artificial Sequence; identical to SEQ ID NO: 12881
  derived and/or modified sequence opt1 from anti-influenza_Chain

SEQ ID NO: 12883 - RNA, 1329 nt, Artificial Sequence
  derived and/or modified sequence opt1 from anti-influenza_Chain
gaggugcagcugcagcagagcggccccgagcucgucaagccgggggccuccgugaagaugagcugcaaggccuccggcuacaccuucaccagcuacgugaugcacugggucaagcagaagcccgggcagggccuggaguggaucggguacaucaaccccuacaacgacggcacgcgcuacaacgagaaguuccgggugaaggccacccugaccuccgacaagagcuccagcaccgccuacauggagcucuccagccugacguccgaggacagcgccguguacuacugcgcccgccggggccugaucaccacccccacccucgacuacugggggcagggcacgacccugaccgucuccagcgccaagaccacgccgcccuccguguacccccuggcgcccgggagcgccgcccagaccaacuccauggugacccucggcugccuggucaagggguacuucccggagcccgugaccgugacguggaacagcggcucccugagcagcggcguccacaccuuccccgccgugcuccaguccgaccuguacacccugagcuccagcgugaccguccccuccagcacguggccguccgagaccgugaccugcaacguggcgcaccccgccagcuccaccaaggucgacaagaagaucgugccccgcgacugcgggugcaagcccugcaucugcacggugccggaggucagcuccguguucaucuucccgcccaagcccaaggacgugcucaccaucacccugacccccaaggucacgugcguggucguggacaucagcaaggacgaccccgaggugcaguucuccugggucgacgacguggaggugcacaccgcccagacccagccccgggaggagcaguucaacagcaccuuccgcuccgucagcgagcugcccaucaugcaccaggacuggcucaacggcaaggaguucaagugccgggugaacuccgccgccuucccggcgcccaucgagaagacgaucagcaagaccaaggggcgccccaaggcgccccagguguacaccaucccgccgcccaaggagcagauggccaaggacaaggucucccugaccugcaugaucacggacuucuuccccgaggacaucaccguggaguggcaguggaacggccagcccgccgagaacuacaagaacacccagcccaucauggacaccgacggcagcuacuucguguacagcaagcugaacguccagaaguccaacugggaggccgggaacaccuucacgugcagcgugcuccacgagggccugcacaaccaccacaccgagaagucccugagccacucccccgggaag

SEQ ID NO: 12884 - RNA, 1329 nt, Artificial Sequence; identical to SEQ ID NO: 12883
  derived and/or modified sequence opt1 from anti-influenza_Chain

SEQ ID NO: 12885 - RNA, 1332 nt, Artificial Sequence
  derived and/or modified sequence opt1 from anti-influenza_Chain
aacgugcccgaguggagcuacaucgucgagaaggccaacccggccaacgaccugugcuaccccggcaacuucaacgacuacgaggagcucaagcaccuccugucccgcaucaaccacuucgagaagauccagaucauccccaagagcuccuggagcgaccacgaggcguccagcgggguguccagcgccugccccuaccagggcaccccguccuucuuccggaacguggucuggcugaucaagaagaacaacaccuaccccacgaucaagcgcagcuacaacaacaccaaccaggaggaccugcugauccucugggggauccaccacuccaacgacgccgccgagcagaccaagcuguaccagaaccccaccacguacaucagcgugggcaccuccacccugaaccagcggcucgugcccaagaucgccacccgcagcaaggucaacgggcagaacggccggauggacuucuucuggacgauccugaagccgaacgacgcgaucaacuucgaguccaacggcaacuucaucgcccccgaguacgccuacaagaucgugaagaagggguacauccccgaggcgccccgcgacggccaggccuacgugcggaaggacggggaguggguccugcucagcaccuuccugcgcuccgacaagacccacacgugcccgcccugccccgcccccgagcugcucggcgggccgagcguguuccuguucccgcccaagcccaaggacacccugaugaucucccggacccccgaggugaccugcgucgugguggacgucagccacgaggaccccgaggugaaguucaacugguacguggacggcgucgaggugcacaacgccaagaccaagccccgcgaggagcaguacaacagcacguaccggguggucuccgugcucaccgugcugcaccaggacuggcugaacggcaaggaguacaagugcaaggucagcaacaaggcccuccccgccccgaucgagaagaccaucuccaaggcgaaggggcagccccgcgagccccagguguacacccugcccccgagccgggaggagaugacgaagaaccaggucucccugaccugccucgugaagggcuucuaccccagcgacaucgccguggagugggaguccaacgggcagcccgagaacaacuacaagaccaccccgcccguccuggacagcgacggcuccuucuuccuguacagcaagcucacgguggacaagucccgcuggcagcagggcaacguguucagcugcuccgucaugcacgaggcccugcacaaccacuacacccagaagucccugagccucagccccgggaag

SEQ ID NO: 12886 - RNA, 1332 nt, Artificial Sequence; identical to SEQ ID NO: 12885
  derived and/or modified sequence opt1 from anti-influenza_Chain

SEQ ID NO: 12887 - RNA, 1341 nt, Artificial Sequence
  derived and/or modified sequence opt1 from anti-influenza_Chain
caggugcagcugcaggagagcggccccgggcucgucaagccguccgagacccugagccugaccugcaccguguccggcgggcucaucggcaccgggagcuacuacuggggcuggauccgccagacccccggcaaggggauggaguggaucggcuccaucagcuacuccgggagcaccuacuaccaccccucccucaagagccgggugacgaucuccgacgacaccagcaagaaccagcuguuccugaagcugcgcuccgucaccgccgccgacaccgcgcaguacuacugcgcccgguacaacuggggcauccgcuacuucgacuucugggggcggggcacgcuggugaccgugagcuccgccagcaccaagggccccuccgucuucccgcucgcccccugcagccgcuccaccagcgagagcacggccgcgcuggggugccuggugaaggacuacuuccccgagcccgugaccgucuccuggaacagcggcgcccucaccuccggggugcacaccuucccggccgugcugcagagcuccggccuguacagccucuccagcgucgugacggugcccuccagcucccugggcaccaagaccuacacgugcaacgucgaccacaagcccagcaacaccaagguggacaagacccgggaguccaaguacgggcccccgugccccagcugccccgcccccgaguuccugggcgggccguccguguuccucuucccgcccaagcccaaggacacccugaugaucagccgcacccccgaggucacgugcgugguggucgacgugucccaggaggaccccgaggugcaguucaacugguacgucgacggcguggagguccacaacgcgaagaccaagccccgggaggagcaguucaacagcaccuaccgcgugguguccguccugaccgugcuccaccaggacuggcugaacgggaaggaguacaagugcaaggugagcaacaagggccugcccagcuccaucgagaagacgaucagcaaggccaagggccagccgcgggagccccaggucuacacccucccgcccgcccaggaggagaugaccaagaaccaggugucccugaccugccuggugaagggguucuaccccagcgacaucgccgucgagugggaguccaacggccagcccgagaacaacuacaagacgacgcccccggugcucgacagcgacggguccuucuuccuguacagccgccugaccguggacaagucccgguggcaggagggcaacgucuucagcugcuccgugaugcacgaggcccuccacaaccacuacacccagaagucccugagccugagccucgggaag

SEQ ID NO: 12888 - RNA, 1341 nt, Artificial Sequence; identical to SEQ ID NO: 12887
  derived and/or modified sequence opt1 from anti-influenza_Chain

SEQ ID NO: 12889 - RNA, 1344 nt, Artificial Sequence
  derived and/or modified sequence opt1 from anti-influenza_Chain
gaggugcagcugcaggagagcggccccgggcucgucaagcccucccagacccugagccugaccugcaacguguccggcgggagcaucacgggcgacuacaagugguccuggauccgccagccgcccgggaagggccucgaguggaucggccacauccacagcaccgggaccaccuacuacaaccccucccugcggagccgcaucacgaucuccauggacaccagcaagaacaaccugucccuccggcugaccagcgugaccgccgccgacacggcggucuacuacugcgccucccacacccugaccagcggccacuacccccgcgacuucgacuucugggggcagggcacccucgugacgguguccagcgccuccaccaaggggcccagcgucuucccccuggcccccugcucccggagcaccagcgaguccaccgccgcgcugggcugccucgugaaggacuacuucccggagcccgugacggucagcuggaacuccggcgcccugaccagcggggugcacaccuuccccgccgugcugcaguccagcggccucuacucccugagcuccgucgugaccgugacgagcuccaacuucgggacccagaccuacacgugcaacgucgaccacaagcccagcaacaccaagguggacaagaccguggagcgcaagugcugcgucgagugcccgcccugccccgcgcccccgguggccggccccuccguguuccuguucccgcccaagcccaaggacacccucaugaucagccggacccccgaggucacgugcgugguggucgacgugucccacgaggaccccgagguccaguucaacugguacguggacggcauggaggugcacaacgccaagaccaagccccgcgaggagcaguucaacagcaccuuccgggucguguccgugcugaccgucgugcaccaggacuggcugaacgggaaggaguacaagugcaaggugagcaacaagggccucccggcccccaucgagaagacgaucuccaagaccaaggggcagccccgcgagccccaggucuacacccugccgcccagccgggaggagaugaccaagaaccaggugagccugacgugccucgugaagggcuucuaccccuccgacaucgccgucgagugggagagcaacgggcagccggagaacaacuacaagaccaccccgcccaugcuggacuccgacggcagcuucuuccuguacuccaagcucaccguggacaagagccgcuggcagcagggcaacguguucuccugcagcgucaugcacgaggcccugcacaaccacuacacccagaagucccugagccucuccgggaag

SEQ ID NO: 12890 - RNA, 1350 nt, Artificial Sequence
  derived and/or modified sequence opt1 from anti-influenza_Chain
caggugcagcugcagcagagcggcgccgaggucaagaagcccggguccagcgugaagguguccugcaaggucagcggcgugaucuucuccgggagcgccaucuccugggugcgccaggcgccgggccaggggcucgaguggaugggcggcaucagcccccuguucgggaccaccaacuacgcccagaaguuccagggccgggucacgaucaccgccgaccaguccaccaacaccacguacauggaggugaacagccugcgcuacgaggacaccgccguguacuucugcgcccgggggcccaaguacuacuccgaguacauggacgucuggggcaaggggaccaccgugacggugagcuccgcgagcaccaagggccccuccgucuucccgcucgcccccagcuccaagagcaccuccggcgggaccgccgcccugggcugccuggugaaggacuacuuccccgagcccgugacggucagcuggaacagcggggcgcucaccuccggcgugcacaccuucccggccgugcugcagagcuccggccuguacagccucuccagcgucgugaccgugcccuccagcucccuggggacgcagaccuacaucugcaacgucaaccacaagcccagcaacaccaagguggacaagcgcguggagcccaaguccugcgacaagacccacacgugcccgcccugccccgcccccgagcugcucggcgggccgagcgucuuccuguucccgcccaagcccaaggacacccugaugaucucccggacccccgaggugaccugcgucgugguggacgucagccacgaggaccccgaggugaaguucaacugguacguggacggcgucgaggugcacaacgccaagacgaagccccgcgaggagcaguacaacuccaccuaccggguggucagcgugcucaccgugcugcaccaggacuggcugaacgggaaggaguacaagugcaaggucuccaacaaggcccuccccgcgccgaucgagaagaccaucagcaaggccaagggccagccccgcgagccccagguguacacgcugcccccgucccgggaggagaugaccaagaaccaggugagccugaccugccucgucaagggcuucuaccccagcgacaucgccguggagugggaguccaacgggcagcccgagaacaacuacaagaccacgccgcccgugcuggacagcgacggcuccuucuuccuguacagcaagcucaccgucgacaagucccgcuggcagcaggggaacguguucagcugcuccgugaugcacgaggcccugcacaaccacuacacccagaagucccugagccucagccccggcaag

SEQ ID NO: 12891 - RNA, 1350 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggaccuucuccagcuacgcgaucuccugggugcgccaggccccgggccaggggcucgaguggaugggcggcaucauggggauguucggcaccacgaacuacgcccagaaguuccaggggcgggugaccaucaccgccgacgaguucaccagcgccgcguacauggagcugcgcucccugcggagcgaggacacggccgucuacuacugcgcccgcuccagcggcuacuaccccgaguacuuccaggacugggggcagggcacccucgugaccguguccagcgccuccaccaagggccccagcgucuucccccuggcgccguccagcaaguccacgagcgggggcaccgccgcccuggggugccucgugaaggacuacuuccccgagcccgugaccgucagcuggaacuccggcgcccugaccagcggcgugcacacguuccccgccgugcugcaguccagcgggcucuacucccugagcuccgucgugaccgugccgagcuccagccugggcacccagaccuacaucugcaacgucaaccacaagcccuccaacacgaagguggacaagcggguggagcccaagagcugcgacaagacccacacgugcccgcccugccccgcgcccgagcuccucgggggccccuccgucuuccuguucccgcccaagcccaaggacacccugaugaucagccgcacccccgaggugaccugcguggucguggacgucucccacgaggacccggaggugaaguucaacugguacguggacggggucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcccccaucgagaagaccaucuccaaggccaagggccagccgcgggagccccagguguacacccugccgcccagccgcgaggagaugaccaagaaccaggugagccucacgugccuggucaagggguucuaccccuccgacaucgcgguggagugggagagcaacggccagcccgagaacaacuacaagaccacgcccccggugcuggacuccgacgggagcuucuuccucuacuccaagcugaccgucgacaagagccgguggcagcagggcaacguguucuccugcagcgugaugcacgaggcccugcacaaccacuacacccagaagucccucagccugucccccgggaag

SEQ ID NO: 12892 - RNA, 1350 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacggcaucuccugggugcgccaggcgccggggcagggccucgaguggaugggcgacaucaucgggauguucggcagcaccaacuacgcccagaacuuccaggggcggcugacgaucaccgccgacgaguccaccagcaccgccuacauggagcuguccagccuccgcuccgaggacacggccguguacuacugcgcgcggagcuccggcuacuaccccgccuaccugccccacugggggcagggcacccuggucaccgugagcuccgccagcaccaagggccccuccguguucccgcucgcccccagcagcaaguccacgagcgggggcaccgcggcccuggggugccuggucaaggacuacuuccccgagcccgugaccguguccuggaacagcggcgcccucaccuccggcguccacacguucccggccgugcugcagagcuccgggcuguacagccucuccagcguggucaccgugcccuccagcucccugggcacccagaccuacaucugcaacgugaaccacaagcccagcaacacgaaggucgacaagcgcguggagcccaaguccugcgacaagacccacacgugcccgcccugccccgcccccgagcugcucgggggcccgagcguguuccuguucccgcccaagcccaaggacacccugaugaucucccggacccccgaggugaccugcgucguggucgacgugagccacgaggaccccgaggucaaguucaacugguacguggacgggguggagguccacaacgcgaagaccaagccccgcgaggagcaguacaacuccaccuaccggguggugagcguccucacggugcugcaccaggacuggcugaacggcaaggaguacaagugcaaggugagcaacaaggcccuccccgccccgaucgagaagaccaucuccaaggccaagggccagccccgcgagccccaggucuacacccugcccccgagccgggaggagaugaccaagaaccaggugucccugacgugccucgugaagggguucuaccccagcgacaucgccgucgagugggaguccaacggccagcccgagaacaacuacaagaccaccccgcccgugcuggacagcgacggguccuucuuccuguacagcaagcucaccguggacaagucccgcuggcagcagggcaacgucuucagcugcuccgugaugcacgaggcgcugcacaaccacuacacgcagaagucccugagccucagccccgggaag

SEQ ID NO: 12893 - RNA, 1350 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccagcuacgcgaucuccugggugcgccaggccccgggccaggggcucgaguggaugggcggcaucaucgggauguucggcaccgccaacuacgcccagaaguuccaggggcgggugacgaucaccgccgacgaguucaccagcaccgcguacauggagcuguccagccugcgcuccgaggacacggccgucuacuacugcgcccggggcaacuacuacuacgagagcucccucgacuacugggggcagggcacccuggugaccgugagcuccgccagcaccaagggccccuccgucuucccccuggcgcccagcuccaagagcacgagcgggggcaccgccgcccucgggugccuggugaaggacuacuucccggagcccgugaccgucuccuggaacagcggcgcccugaccuccggcgugcacacguuccccgccgugcuccagagcuccgggcuguacagccuguccagcgucgugaccgugcccuccagcucccucggcacccagaccuacaucugcaacgucaaccacaagccgagcaacacgaagguggacaagcgcguggagcccaaguccugcgacaagacccacacgugcccgcccugcccggcgcccgagcugcucgggggccccagcgucuuccuguucccgcccaagcccaaggacacccugaugaucucccggacccccgaggugaccugcguggucguggacgucagccacgaggaccccgaggugaaguucaacugguacguggacggggucgaggugcacaacgccaagaccaagccgcgcgaggagcaguacaacuccaccuaccggguggucagcgugcugacggugcuccaccaggacuggcugaacggcaaggaguacaagugcaaggucuccaacaaggcccugcccgcccccaucgagaagaccaucagcaaggccaagggccagccccgcgagccccagguguacacccucccgcccagccgggaggagaugaccaagaaccaggugucccugacgugccuggucaagggguucuaccccagcgacaucgcgguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcccuccacaaccacuacacgcagaagucccugagccugagccccgggaag

SEQ ID NO: 12894 - RNA, 1350 nt, Artificial Sequence
  derived and/or modified sequence opt1 from anti-influenza_Chain
gaggugcagcugguccagagcggcgccgaggugaagaagcccggguccagcaugaagguguccugcaaggccagcggcuccaucuucagcaacuacgggaucuccuggguccgccaggcgccgggccaggggcucgaguggaugggcggcaucauccccaucuucggggccgccaacuacgcccagaaguuccagggccgggugaccaucaccgccgacgagagcacguccaccguguacauggagguccgcagccugcgguccgaggacaccgcgguguacuacugcgcccgccggcagcagcuguacaagggguacuaccaccacuggggccaggggacccucgugacggucagcuccgccagcaccaagggccccuccguguucccccuggccccgagcuccaagagcaccuccggcgggaccgcggcccugggcugccucgugaaggacuacuuccccgagcccgucacggugagcuggaacagcggggcccugaccuccggcgugcacaccuuccccgccguccugcagagcuccggccucuacagccuguccagcguggugaccgucccguccagcucccuggggacgcagaccuacaucugcaacgugaaccacaagcccagcaacaccaagguggacaagaaggucgagcccaaguccugcgacaagacccacacgugcccgcccugccccgcccccgagcuccugggcgggcccagcguguuccuguucccgcccaagcccaaggacacccucaugaucucccgcacccccgaggugaccugcgucguggucgacgugagccacgaggacccggaggugaaguucaacugguacgucgacggcguggaggugcacaacgcgaagacgaagccccgggaggagcaguacaacuccaccuaccgcgucgugagcgugcugaccguccugcaccaggacuggcucaacgggaaggaguacaagugcaagguguccaacaaggcccugcccgcccccaucgagaagaccaucagcaaggccaagggccagccgcgggagccccagguguacacgcugccgcccucccgcgaggagaugaccaagaaccaggucagccugaccugccucgugaagggcuucuaccccagcgacaucgccguggagugggaguccaacgggcagcccgagaacaacuacaagaccacgcccccgguccuggacagcgacggcuccuucuuccucuacagcaagcugaccguggacaagucccgguggcagcaggggaacguguucagcugcuccgucaugcacgaggcgcugcacaaccacuacacccagaagucccucagccugagccccggcaag

SEQ ID NO: 12895 - RNA, 1350 nt, Artificial Sequence
  derived and/or modified sequence opt1 from anti-influenza_Chain
caggugcagcugguccagagcggcgccggggugaagaagcccggcuccagcaugaagguguccugcaaggccagcggguccaucuucagcaacuacggcaucuccuggguccgccaggcgccggggcagggccucgaguggaugggcgggaucauccccaucuucggcgccgccaacuacgcccagaaguuccaggggcgggugaccaucaccgccgacgagagcacguccaccguguacauggagguccgcagccugcgguccgaggacaccgcgguguacuacugcgcccgccggcagcagcuguacaagggcuacuaccaccacugggggcagggcacccucgugacggucagcuccgccagcaccaagggccccuccguguucccccuggccccgagcuccaagagcaccuccgggggcaccgcggcccuggggugccucgugaaggacuacuuccccgagcccgucacggugagcuggaacagcggcgcccugaccuccggcgugcacaccuuccccgccguccugcagagcuccgggcucuacagccuguccagcguggugaccgucccguccagcucccugggcacgcagaccuacaucugcaacgugaaccacaagcccagcaacaccaagguggacaagaaggucgagcccaaguccugcgacaagacccacacgugcccgcccugccccgcccccgagcuccucgggggccccagcguguuccuguucccgcccaagcccaaggacacccucaugaucucccgcacccccgaggugaccugcgucguggucgacgugagccacgaggacccggaggugaaguucaacugguacgucgacgggguggaggugcacaacgcgaagacgaagccccgggaggagcaguacaacuccaccuaccgcgucgugagcgugcugaccguccugcaccaggacuggcucaacggcaaggaguacaagugcaagguguccaacaaggcccugcccgcccccaucgagaagaccaucagcaaggccaagggccagccgcgggagccccagguguacacgcugccgcccucccgcgaggagaugaccaagaaccaggucagccugaccugccuggugaagggguucuaccccagcgacaucgccguggagugggaguccaacggccagcccgagaacaacuacaagaccacgcccccgguccuggacagcgacggguccuucuuccucuacagcaagcugaccguggacaagucccgguggcagcagggcaacguguucagcugcuccgucaugcacgaggcgcugcacaaccacuacacccagaagucccucagccugagccccgggaag

SEQ ID NO: 12896 - RNA, 1350 nt, Artificial Sequence
  derived and/or modified sequence opt1 from anti-influenza_Chain
caggugcagcugguccagagcggcgccgaggugcgcaagcccggguccagcgugaaggucuccugcaaggugagcggcgggaucauccggaaguacgccaucaacugggugcgccaggcgccgggccaggggcucgaguggaugggcggcaucaucgccaucuucaacaccgccaacuacgcccagaaguuccaggggcgggucaccaucacggccgacgaguccaccagcaccguguacauggagcuguccagccugcgcuccgaggacaccgcgcucuacuacugcgcccggggcaugaacuacuacagcgacuacuucgacuacugggggcagggcucccuggugacggucagccccgccuccaccaaggggcccagcguguucccccuggccccguccagcaaguccaccagcggcggcaccgcggcccucgggugccuggugaaggacuacuuccccgagcccgucacgguguccuggaacagcggcgcccugaccagcggggugcacaccuuccccgccguccuccaguccagcggccuguacucccugagcuccguggugaccgucccgagcuccagccucggcacgcagaccuacaucugcaacgugaaccacaagcccuccaacaccaagguggacaagaaggucgagcccaagagcugcgacaagacccacacgugcccgcccugccccgcccccgagcugcucgggggccccuccguguuccuguucccgcccaagcccaaggacacccugaugaucagccgcacccccgaggugaccugcgucguggucgacgugucccacgaggacccggaggugaaguucaacugguacgucgacgggguggaggugcacaacgcgaagacgaagccccgggaggagcaguacaacagcaccuaccgcgucguguccgugcugaccguccuccaccaggacuggcugaacggcaaggaguacaagugcaaggugagcaacaaggcccugcccgcccccaucgagaagaccaucuccaaggccaaggggcagccgcgggagccccagguguacacgcucccgcccagccgcgacgagcugaccaagaaccaggucucccugaccugccucgugaagggcuucuaccccagcgacaucgccguggagugggagagcaacggccagcccgagaacaacuacaagaccacgcccccgguccuggacuccgacgggagcuucuuccuguacuccaagcucaccguggacaagagccgguggcagcagggcaacguguucuccugcagcgucaugcacgaggcgcugcacaaccacuacacccagaagucccugagccucucccccgggaag

SEQ ID NO: 12897 - RNA, 1350 nt, Artificial Sequence; identical to SEQ ID NO: 12896
  derived and/or modified sequence opt1 from anti-influenza_Chain

SEQ ID NO: 12898 - RNA, 1350 nt, Artificial Sequence; identical to SEQ ID NO: 12894
  derived and/or modified sequence opt1 from anti-influenza_Chain

SEQ ID NO: 12899 - RNA, 1350 nt, Artificial Sequence; identical to SEQ ID NO: 12895
  derived and/or modified sequence opt1 from anti-influenza_Chain

SEQ ID NO: 12900 - RNA, 1350 nt, Artificial Sequence; identical to SEQ ID NO: 12890
  derived and/or modified sequence opt1 from anti-influenza_Chain

SEQ ID NO: 12901 - RNA, 1350 nt, Artificial Sequence; identical to SEQ ID NO: 12891
  derived and/or modified sequence opt1 from anti-influenza_Chain

SEQ ID NO: 12902 - RNA, 1350 nt, Artificial Sequence; identical to SEQ ID NO: 12892
  derived and/or modified sequence opt1 from anti-influenza_Chain

SEQ ID NO: 12903 - RNA, 1350 nt, Artificial Sequence; identical to SEQ ID NO: 12893
  derived and/or modified sequence opt1 from anti-influenza_Chain

SEQ ID NO: 12904 - RNA, 1353 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccgccagcacgaagggccccuccguguucccccuggcccccagcuccaagagcaccuccgggggcaccgcggcccucgggugccuggucaaggacuacuucccggagcccgugaccgugagcuggaacuccggcgcccugacgagcggcguccacaccuuccccgccgugcuccagagcuccgggcuguacagccuguccagcguggucaccgugcccuccagcucccucggcacccagacguacaucugcaacgugaaccacaagccgagcaacaccaaggucgacaagcggguggagcccaaguccugcgacaagacccacacgugcccgcccugccccgcccccgagcugcucgggggccccagcguguuccuguucccgcccaagcccaaggacacccugaugaucucccgcacccccgaggugaccugcgucgucguggacgugagccacgaggaccccgaggucaaguucaacugguacguggacgggguggagguccacaacgcgaagaccaagccgcgggaggagcaguacaacuccacguaccgcguggugagcguccugaccgugcuccaccaggacuggcugaacggcaaggaguacaagugcaagguguccaacaaggcccugcccgcccccaucgagaagaccaucagcaaggccaagggccagccccgggagccgcaggucuacacccucccgcccucccgcgaggagaugacgaagaaccaggugagccugaccugccuggugaagggguucuaccccuccgacaucgccgucgagugggagagcaacggccagcccgagaacaacuacaagaccaccccgcccgugcucgacagcgacggguccuucuuccuguacagcaagcugacgguggacaagucccgguggcagcagggcaacgucuucagcugcuccgugaugcacgaggcgcuccacaaccacuacacccagaagucccugagccugagccccgggaag

SEQ ID NO: 12905 - RNA, 1353 nt, Artificial Sequence
  derived and/or modified sequence opt1 from anti-influenza_Chain
caggugcagcugguccagagcggcgccgaggugaagaagcccggguccagcgugaaggucuccugcaaggccagcggcgggccguuccgcuccuacgcgaucagcugggugcggcaggcccccggccaggggcccgaguggaugggcggcaucauccccaucuucgggaccaccaaguacgccccgaaguuccagggccgcgugacgaucaccgccgacgacuucgccgggaccgucuacauggagcucuccagccugcgguccgaggacaccgcgauguacuacugcgccaagcacaugggcuaccaggugcgcgagacgauggacgugugggggaagggcaccaccgucaccgugagcuccgccagcacgaagggccccuccguguucccccuggcccccagcuccaagagcaccuccgggggcaccgcggcccucgggugccuggucaaggacuacuucccggagcccgugaccgugagcuggaacuccggcgcccugacgagcggcguccacaccuuccccgccgugcuccagagcuccgggcuguacagccuguccagcguggucaccgugcccuccagcucccucggcacccagacguacaucugcaacgugaaccacaagccgagcaacaccaaggucgacaagcggguggagcccaaguccugcgacaagacccacacgugcccgcccugccccgcccccgagcugcucgggggccccagcguguuccuguucccgcccaagcccaaggacacccugaugaucucccgcacccccgaggugaccugcgucgucguggacgugagccacgaggaccccgaggucaaguucaacugguacguggacgggguggagguccacaacgcgaagaccaagccgcgggaggagcaguacaacuccacguaccgcguggugagcguccugaccgugcuccaccaggacuggcugaacggcaaggaguacaagugcaagguguccaacaaggcccugcccgcccccaucgagaagaccaucagcaaggccaagggccagccccgggagccgcaggucuacacccucccgcccucccgcgaggagaugacgaagaaccaggugagccugaccugccuggugaagggguucuaccccuccgacaucgccgucgagugggagagcaacggccagcccgagaacaacuacaagaccaccccgcccgugcucgacagcgacggguccuucuuccuguacagcaagcugacgguggacaagucccgguggcagcagggcaacgucuucagcugcuccgugaugcacgaggcgcuccacaaccacuacacccagaagucccugagccugagccccgggaag

SEQ ID NO: 12906 - RNA, 1353 nt, Artificial Sequence
  derived and/or modified sequence opt1 from anti-influenza_Chain
gaggugcagcuggucgagagcggcgccgaggugaagaagcccggguccagcgugaaggucuccugcaaggccagcggcgggaccuucuccuucuacagcauguccugggugcgccaggcgccgggccaggggcucgaguggaugggcggcaucauccccauguucgggaccacgaacuacgcccagaaguuccagggccgggugaccaucaccgccgucgagagcaccuccacggccuacauggaggugagcucccugcgcagcgaggacaccgccguguacuacugcgcgcgcggggacaagggcaucuacuacuacuacauggacgucugggggaagggcaccaccgugacgguguccagcgccuccaccaagggccccagcgucuucccccuggccccguccagcaaguccaccagcgggggcaccgccgcgcucgggugccuggugaaggacuacuuccccgagcccgugacggucagcuggaacuccggcgcccugaccagcggcgugcacaccuuccccgccgugcuccaguccagcgggcuguacucccugagcuccgucgugaccgugccgagcuccagccucggcacgcagaccuacaucugcaacgucaaccacaagcccuccaacaccaagguggacaagcggguggagcccaagagcugcgacaagacccacacgugcccgcccugccccgcccccgagcugcucgggggccccuccgucuuccuguucccgcccaagcccaaggacacccugaugaucagccggacccccgaggugaccugcgucgugguggacgucucccacgaggacccggaggugaaguucaacugguacguggacggggucgaggugcacaacgccaagacgaagccccgcgaggagcaguacaacagcaccuaccggguggucuccgugcugaccgugcuccaccaggacuggcugaacggcaaggaguacaagugcaaggucagcaacaaggcgcugcccgcccccaucgagaagaccaucuccaaggccaagggccagccgcgcgagccccagguguacacgcucccgcccagccgggaggagaugaccaagaaccaggugagccugaccugccuggucaagggguucuaccccuccgacaucgccguggagugggagagcaacggccagcccgagaacaacuacaagaccacgcccccggugcucgacuccgacgggagcuucuuccuguacuccaagcugaccgucgacaagagccgcuggcagcagggcaacguguucuccugcagcgugaugcacgaggcccuccacaaccacuacacccagaagucccugagccugucccccgggaag

SEQ ID NO: 12907 - RNA, 1353 nt, Artificial Sequence; identical to SEQ ID NO: 12904
  derived and/or modified sequence opt1 from anti-influenza_Chain

SEQ ID NO: 12908 - RNA, 1353 nt, Artificial Sequence; identical to SEQ ID NO: 12905
  derived and/or modified sequence opt1 from anti-influenza_Chain

SEQ ID NO: 12909 - RNA, 1353 nt, Artificial Sequence; identical to SEQ ID NO: 12906
  derived and/or modified sequence opt1 from anti-influenza_Chain

SEQ ID NO: 12910 - RNA, 1356 nt, Artificial Sequence
  derived and/or modified sequence opt1 from anti-influenza_Chain
caggugcagcugguccagagcggcgggggccucgugaagcccgggggcucccugcgccugagcugcgccgccuccggguucaccuucagcuccuacagcaugaacugggugcggcaggcgccgggcaagggccucgagugggucuccagcaucuccagcuccagcuccuacaucuacuacguggacagcgugaaggggcgcuucaccaucucccgggacaacgccaagaacagccuguaccugcagaugaacucccuccgcgccgaggacacggccgucuacuacugcgcccggggcgggggcagcuacggggcguacgagggcuucgacuacuggggccaggggacccuggugaccguguccagcgccagcaccaagggccccuccgucuucccccuggcccccagcuccaagagcacguccgggggcaccgccgcgcucggcugccuggugaaggacuacuucccggagcccgugaccgucagcuggaacuccggggcccugaccagcggcgugcacacguuccccgccgugcuccaguccagcgggcuguacucccugagcuccgucgugaccgugcccagcuccagccucggcacccagaccuacaucugcaacgucaaccacaagccguccaacacgaagguggacaagcgcguggagcccaagagcugcgacaagacccacacgugcccgcccugcccggcccccgagcugcucgggggccccuccgucuuccuguucccgcccaagcccaaggacacccugaugaucagccggacccccgaggugaccugcguggucguggacgucagccacgaggaccccgaggugaaguucaacugguacguggacggcgucgaggugcacaacgccaagaccaagccgcgcgaggagcaguacaacuccaccuaccggguggucagcgugcugacggugcuccaccaggacuggcugaacgggaaggaguacaagugcaaggucuccaacaaggcgcugcccgcccccaucgagaagaccaucagcaaggccaagggccagccccgcgagccccagguguacacccucccgcccucccgggaggagaugaccaagaaccaggugagccugacgugccuggucaagggguucuaccccuccgacaucgccguggagugggagagcaacggccagcccgagaacaacuacaagaccaccccgcccgugcucgacuccgacgggagcuucuuccuguacuccaagcugaccgucgacaagagccgcuggcagcagggcaacguguucuccugcagcgugaugcacgaggcccuccacaaccacuacacgcagaagucccugagccugucccccggcaag

SEQ ID NO: 12911 - RNA, 1356 nt, Artificial Sequence
  derived and/or modified sequence opt1 from anti-influenza_Chain
caggugcagcugguccagagcggcgccgaggugaagcagcccggggccuccgugaaggucagcugcaaggcguccggcuacaccuucaacgccuacuacauccacugggugcgccaggcccccgggcagggccucgaguggaugggguggaucaaccccaacuucggcggcacccacuacgcccggaaguuccaggggcgcgugacgaugacccgggacgccagcaucaacaccgcguacauggagcuggaccgccugaucuccgacgacaccgccgucuacuacugcgugcgguggcgcgccgccgcggugaucauggaccaguucuacaagauggacgucuggggccaggggacgcucgugaccgugagcuccgccagcaccaagggccccuccgucuucccccuggccccgugcagccgguccaccagcgaguccacggccgcccuggggugccucgugaaggacuacuuccccgagcccgugaccgucagcuggaacuccggcgcgcugaccagcggcgugcacaccuuccccgccgugcugcaguccagcgggcucuacucccugagcagcgucgugacggugccguccagcucccugggcaccaagaccuacacgugcaacgucgaccacaagcccagcaacaccaagguggacaagacccgcgaguccaaguacgggccgcccugccccagcugccccgcccccgaguuccucggcggccccuccguguuccuguucccgcccaagcccaaggacacccugaugaucagccggacccccgaggucacgugcguggucguggacgugucccaggaggacccggagguccaguucaacugguacguggacgggguggagguccacaacgccaagaccaagccccgcgaggagcaguucaacagcaccuaccgggugguguccguccucaccgugcugcaccaggacuggcugaacggcaaggaguacaagugcaaggugagcaacaaggggcuccccuccagcaucgagaagacgaucuccaaggccaagggccagccccgcgagccgcaggucuacacccugccgcccgcgcaggaggagaugaccaagaaccaggugagccugaccugccucgugaagggguucuaccccuccgacaucgccgucgagugggagagcaacggccagcccgagaacaacuacaagacgaccccgcccgugcuggacuccgacggcagcuucuuccuguacagccggcucaccguggacaagucccgcuggcaggaggggaacgucuucagcugcuccgugaugcacgaggcccugcacaaccacuacacccagaagucccugagccucagccugggcaag

SEQ ID NO: 12912 - RNA, 1356 nt, Artificial Sequence
  derived and/or modified sequence opt1 from anti-influenza_Chain
gaggugcagcugguccagagcggcgccgaggugaagaagcccggggccuccgugaaggucagcugcaaggcguccggcuacaucuucaccggguacuacauccacugggugcgccaggccccgggccaggggcucgaguggaugggccggaucgaccccaacggcgccgggaccacguacgcccagaaguuccagggccgcgugacccugaccauggacaccagcaucacgaccgccuacauggagcugucccggcuccgcuucgacgacaccgcgaucuacuacugcgcccggugggacuggaacuucgaccuguaccuggggugguucgaccccuggggccaggggacccccgucacgguggccagcgccuccaccaagggcccgagcguguucccccucgcgcccuccagcaaguccaccagcggcgggaccgccgcccugggcugccuggucaaggacuacuuccccgagccggugacgguguccuggaacagcggggcccucaccuccggcguccacaccuuccccgccgugcugcagagcuccggccuguacagccucuccagcguggucaccgugcccagcuccagccuggggacgcagaccuacaucugcaacgugaaccacaagcccuccaacaccaaggucgacaagaagguggagcccaagagcugcgacaagacccacacgugcccgcccugcgcgcccgagcugcucggcgggccguccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagacgaagccccgggaggagcaguacaacagcaccuaccgcgugguguccguccucaccgugcugcaccaggacuggcugaacgggaaggaguacaagugcaaggugagcaacaaggcccuccccgccccgaucgagaagaccaucuccaaggccaagggccagccccgggagccccaggucuacacgcugcccccgagccgcgaggagaugaccaagaaccaggugucccugaccugccucgugaagggcuucuaccccagcgacaucgcggucgagugggaguccaacgggcagcccgagaacaacuacaagaccacgccgcccgugcuggacagcgacggcuccuucuuccuguacagcaagcucaccguggacaagucccgguggcagcaggggaacgucuucagcugcagcgugaugcacgaggcccugcacaaccacuacacccagaagucccugagccucucccccggcaag

SEQ ID NO: 12913 - RNA, 1356 nt, Artificial Sequence; identical to SEQ ID NO: 12911
  derived and/or modified sequence opt1 from anti-influenza_Chain

SEQ ID NO: 12914 - RNA, 1356 nt, Artificial Sequence; identical to SEQ ID NO: 12910
  derived and/or modified sequence opt1 from anti-influenza_Chain

SEQ ID NO: 12915 - RNA, 1356 nt, Artificial Sequence; identical to SEQ ID NO: 12912
  derived and/or modified sequence opt1 from anti-influenza_Chain

SEQ ID NO: 12916 - RNA, 1359 nt, Artificial Sequence
  derived and/or modified sequence opt1 from anti-influenza_Chain
caggugcagcugguccagagcggcgccgaggugaagaagcccggguccagcgugcgcgucuccugcaaggccagcggcuccaucuuccggaacuacgcgaugagcugggugcgccaggccccggggcagggccucgaguggaugggcgggaucaucgccaucuucggcacccccaaguacgcccagaaguuccaggggcgggugaccaucacggccgacgaguccaccagcaccgucuacauggagcuguccggccugcgcagcgaggacaccgcgauguacuacugcgcccggaucccccacuacaacuucggguccggcagcuacuucgacuacugggggcagggcacgcucgugaccguguccagcgccuccaccaagggccccagcgucuucccgcuggcccccuccagcaaguccaccagcgggggcacggcggcccuggggugccucgugaaggacuacuuccccgagcccgugaccgucagcuggaacuccggcgcccugaccagcggcgugcacaccuucccggccgugcugcaguccagcgggcucuacucccugagcuccgucgugacggugcccagcuccagccugggcacccagaccuacaucugcaacgucaaccacaagcccuccaacaccaagguggacaagcgcguggagcccaagagcugcgacaagacgcacacgugcccgcccugccccgcccccgagcuccucgggggcccguccgucuuccuguucccgcccaagcccaaggacacccucaugaucagccggacccccgaggugaccugcguggucguggacgucucccacgaggaccccgaggugaaguucaacugguacguggacggggucgaggugcacaacgcgaagaccaagccccgcgaggagcaguacaacagcaccuaccggguggucuccgugcugaccgugcugcaccaggacuggcucaacggcaaggaguacaagugcaaggucagcaacaaggcccugcccgccccgaucgagaagacgaucuccaaggccaagggccagccccgcgagccccagguguacacccugcccccgagccgggaggagaugaccaagaaccaggugagccugaccugccuggucaagggguucuaccccuccgacaucgccguggagugggagagcaacggccagcccgagaacaacuacaagacgaccccgcccgugcuggacuccgacgggagcuucuuccucuacuccaagcugaccgucgacaagagccgcuggcagcagggcaacguguucuccugcagcgugaugcacgaggcgcugcacaaccacuacacccagaagucccucagccugucccccgggaag

SEQ ID NO: 12917 - RNA, 1359 nt, Artificial Sequence
  derived and/or modified sequence opt1 from anti-influenza_Chain
caggugcagcugguccagagcggcgccgaggugaagaagcccggggccuccgugaaggucagcugcaaggcguccggcuacaucuucaccggguacuacauccacugggugcgccaggcccccggccaggggcucgaguggaugggccggaucgaccccaacggcagcgggaccacguacgcccagaaguuccagggccgcgugacccugaccauggacaccuccaucacgaccgccuacauggagcugagccggcuccgcuucgacgacaccgccaucuacuacugcgcgcggugggacuggaacuucgaccuguaccuggggugguucgaccccuggggccaggggacccccgucacgguggccuccgccagcaccaagggcccguccguguucccccucgcccccagcuccaagagcaccuccggcgggaccgcggcccugggcugccuggucaaggacuacuuccccgagccggugacggugagcuggaacuccggggcccucaccagcggcguccacaccuuccccgccgugcugcaguccagcggccuguacucccucagcagcguggucaccgugcccuccagcucccuggggacgcagaccuacaucugcaacgugaaccacaagcccagcaacaccaaggucgacaagaagguggagccgaaguccugcgacaagacccacacgugcccgcccugccccgcccccgagcugcucggcgggcccagcguguuccuguucccgcccaagcccaaggacacccugaugaucucccgcacccccgaggugaccugcgucguggucgacgugagccacgaggaccccgaggucaaguucaacugguacguggacggcguggagguccacaacgcgaagacgaagccccgggaggagcaguacaacuccaccuaccgcguggugagcguccucaccgugcugcaccaggacuggcugaacgggaaggaguacaagugcaagguguccaacaaggcccucccggcccccaucgagaagaccaucagcaaggccaagggccagccccgggagccccaggucuacacgcugccgcccucccgcgaggagaugaccaagaaccaggugagccugaccugccucgugaagggcuucuaccccuccgacaucgccgucgagugggagagcaacgggcagccggagaacaacuacaagaccacgccgcccgugcuggacuccgacggcagcuucuuccuguacuccaagcucaccguggacaagagccgguggcagcaggggaacgucuucagcugcuccgugaugcacgaggcgcugcacaaccacuacacccagaagucccugagccucagccccggcaag

SEQ ID NO: 12918 - RNA, 1359 nt, Artificial Sequence
  derived and/or modified sequence opt1 from anti-influenza_Chain
gaggugcagcugguccagagcggcgccgaggugaagaagcccggggccuccgugaaggucagcugcaaggcguccggcuacaucuucaccggguacuacauccacugggugcgccaggcccccggccaggggcucgaguggaugggccggaucgaccccaacggcgccgggaccacguacgcccagaaguuccagggccgcgugacccugaccauggacaccagcaucacgaccgccuacauggagcugucccggcuccgcuucgacgacaccgcgaucuacuacugcgcccggugggacuggaacuucgaccuguaccuggggugguucgaccccuggggccaggggacccccgucacgguggccagcgccuccaccaagggcccgagcguguucccccucgcgcccuccagcaaguccaccagcggcgggaccgccgcccugggcugccuggucaaggacuacuuccccgagccggugacgguguccuggaacagcggggcccucaccuccggcguccacaccuuccccgccgugcugcagagcuccggccuguacagccucuccagcguggucaccgugcccagcuccagccuggggacgcagaccuacaucugcaacgugaaccacaagcccuccaacaccaaggucgacaagaagguggagcccaagagcugcgacaagacccacacgugcccgcccugccccgcgccggagcugcucggcgggcccuccguguuccuguucccgcccaagcccaaggacacccugaugaucagccgcacccccgaggugaccugcgucguggucgacgugucccacgaggaccccgaggucaaguucaacugguacguggacggcguggagguccacaacgccaagacgaagccccgggaggagcaguacaacagcaccuaccgcgugguguccguccucaccgugcugcaccaggacuggcugaacgggaaggaguacaagugcaaggugagcaacaaggcccucccggcccccaucgagaagaccaucuccaaggccaagggccagccccgggagccccaggucuacacgcugccgcccagccgcgaggagaugaccaagaaccaggugucccugaccugccucgugaagggcuucuaccccagcgacaucgcggucgagugggaguccaacgggcagccggagaacaacuacaagaccacgccgcccgugcuggacagcgacggcuccuucuuccuguacagcaagcucaccguggacaagucccgguggcagcaggggaacgucuucagcugcagcgugaugcacgaggcccugcacaaccacuacacccagaagucccugagccucucccccggcaag

SEQ ID NO: 12919 - RNA, 1359 nt, Artificial Sequence
  derived and/or modified sequence opt1 from anti-influenza_Chain
caggugcagcugguccagagcggcgccgaggugaagaagcccggggccuccgugaaggucagcugcaaggcguccggcuacaccuucaacgcccaccacaugcacugggugcgccaggccccggggcagggccucggguggaugggcuggaucgaccccaacaacgacggcaccaucuacgcccagaaguuccaggggcgggugacgcugaccauggacaccagcauccacaccgccuacauggagcuguccggccuccgcuacgacgacacggcgaucuacuacugcguccggugggccuggaacuucgacuucuuccuggggugguucgaccccuggggccaggggacccuggugaccguggccagcgccuccaccaagggccccagcgucuucccgcucgcgcccuccagcaaguccacgagcggcgggaccgccgcccugggcugccuggugaaggacuacuuccccgagcccgugaccgucuccuggaacagcggggcccucaccuccggcgugcacacguucccggccgugcugcagagcuccggccuguacagccucuccagcgucgugaccgugcccagcuccagccuggggacccagaccuacaucugcaacgucaaccacaagcccuccaacacgaagguggacaagaagguggagcccaagagcugcgacaagacccacacgugcccgcccugccccgcgcccgagcugcucggcgggccguccgucuuccuguucccgcccaagcccaaggacacccugaugaucagccgcacccccgaggugaccugcguggucguggacgucucccacgaggaccccgaggugaaguucaacugguacguggacggcgucgaggugcacaacgccaagaccaagccccgggaggagcaguacaacagcaccuaccgcguggucuccgugcucacggugcugcaccaggacuggcugaacgggaaggaguacaagugcaaggucagcaacaaggcccuccccgccccgaucgagaagaccaucuccaaggccaagggccagccccgggagccccagguguacacccugcccccgagccgcgaggagaugaccaagaaccaggugucccugacgugccucgucaagggcuucuaccccagcgacaucgcgguggagugggaguccaacgggcagcccgagaacaacuacaagaccaccccgcccgugcuggacagcgacggcuccuucuuccuguacagcaagcucaccgucgacaagucccgguggcagcaggggaacguguucagcugcagcgugaugcacgaggcccugcacaaccacuacacgcagaagucccugagccucucccccggcaag

SEQ ID NO: 12920 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgacagcgacaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagcgccuccaccaaggggccgagcguguucccccuggcgcccagcuccaagagcaccuccggcgggacggccgcccucggcugccuggugaaggacuacuuccccgagccggucaccgugagcuggaacuccggcgcccugaccagcggggugcacaccuuccccgcgguccuccaguccagcggccuguacucccugagcuccguggugacgguccccagcuccagccucgggacccagaccuacaucugcaacgugaaccacaagcccuccaacaccaagguggacaagaaggucgagcccaagagcugcgacaagacgcacacgugcccgcccugccccgccccggagcugcugggcgggcccuccguguuccucuucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucgugagcgugcugaccguccuccaccaggacuggcugaacggcaaggaguacaagugcaagguguccaacaaggcccugccggcccccaucgagaagacgaucagcaaggcgaaggggcagccccgcgagccccagguguacacccucccgcccucccgggaggagaugaccaagaaccaggucagccugaccugccuggugaagggcuucuaccccuccgacaucgccguggagugggagagcaacgggcagccggagaacaacuacaagacgaccccgcccguccucgacuccgacggcagcuucuuccuguacuccaagcugaccguggacaagagccgcuggcagcaggggaacguguucuccugcagcgucaugcacgaggcccuccacaaccacuacacccagaagucccugagccugucccccggcaag

SEQ ID NO: 12921 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgacgccgacgcgaucuacagccccuccuuccagggccaggugaccaucagcgccgacaacuccaucagcacggccuaccugcagugguccagccucaaggccuccgacaccgccaucuacuacugcgcgagcgggcccggguacuccggcuaccacuacgggugguucgacaccuggggccagggcacccuggugacggucagcuccgccagcaccaaggggccguccguguucccccuggcccccagcagcaaguccaccagcggcgggaccgccgcgcucggcugccuggugaaggacuacuuccccgagccggucacgguguccuggaacagcggcgcccugaccuccggggugcacaccuuccccgccguccuccagagcuccggccuguacagccuguccagcguggugaccguccccuccagcucccucgggacgcagaccuacaucugcaacgugaaccacaagcccagcaacaccaagguggacaagaaggucgagccgaaguccugcgacaagacccacacgugcccgcccugccccgcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagacgaagccccgcgaggagcaguacaacuccaccuaccgggucgugagcgugcugaccguccuccaccaggacuggcugaacggcaaggaguacaagugcaaggugagcaacaaggcgcugccggcccccaucgagaagaccaucuccaaggccaaggggcagccccgcgagccccagguguacacgcucccgcccagccgggaggagaugaccaagaaccaggucucccugaccugccuggugaagggcuucuaccccagcgacaucgccguggagugggaguccaacgggcagccggagaacaacuacaagaccacgccgcccguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 12922 - RNA, 1359 nt, Artificial Sequence; identical to SEQ ID NO: 8665
  derived and/or modified sequence opt1 from anti-influenza_Chain

SEQ ID NO: 12923 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgacgccgacaccaucuacagccccuccuuccagggccaggugacgaucagcgcggacaacuccaucagcaccgccuaccugcagugguccagccucaaggccuccgacaccgccaucuacuacugcgccagcgggcccggguacuccggcuaccacuacgggugguucgacaccuggggccagggcacgcuggugaccgucagcuccgcgagcaccaaggggccguccguguucccccuggcccccagcagcaaguccaccagcggcgggacggccgcccucggcugccuggugaaggacuacuuccccgagccggucaccguguccuggaacagcggcgcgcugaccuccggggugcacaccuuccccgccguccuccagagcuccggccuguacagccuguccagcguggugacgguccccuccagcucccucgggacccagaccuacaucugcaacgugaaccacaagcccagcaacaccaagguggacaagaaggucgagccgaaguccugcgacaagacgcacacgugcccgcccugccccgcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagaccaagccccgcgaggagcaguacaacuccaccuaccgggucgugagcgugcugaccguccuccaccaggacuggcugaacggcaaggaguacaagugcaaggugagcaacaaggcccugccggcgcccaucgagaagacgaucuccaaggccaaggggcagccccgcgagccccagguguacacccucccgcccagccgggaggagaugaccaagaaccaggucucccugaccugccuggugaagggcuucuaccccagcgacaucgccguggagugggaguccaacgggcagccggagaacaacuacaagacgaccccgcccguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 12924 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcagcuccgacaccaucuacagccccuccuuccagggccaggugacgaucagcgccgacaacuccaucagcaccgcguaccugcagugguccagccucaaggccuccgacaccgccaucuacuacugcgccagcgggcccggguacuccggcuaccacuacgggugguucgacaccuggggccagggcacgcuggugaccgucagcuccgccagcaccaaggggccgagcguguucccccuggcgcccuccagcaaguccaccagcggcgggacggccgcccucggcugccuggugaaggacuacuuccccgagccggucaccguguccuggaacagcggcgcccugaccuccggggugcacaccuuccccgcgguccuccagagcuccggccuguacagccuguccagcguggugacgguccccuccagcucccucgggacccagaccuacaucugcaacgugaaccacaagcccagcaacaccaagguggacaagaaggucgagccgaaguccugcgacaagacgcacacgugcccgcccugccccgcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagaccaagccccgcgaggagcaguacaacagcaccuaccgggucguguccgugcugaccguccuccaccaggacuggcugaacggcaaggaguacaagugcaaggugagcaacaaggcccugccggcccccaucgagaagacgaucuccaaggcgaaggggcagccccgcgagccccagguguacacccucccgcccagccgggaggagaugaccaagaaccaggucucccugaccugccuggugaagggcuucuaccccagcgacaucgccguggagugggaguccaacgggcagccggagaacaacuacaagacgaccccgcccguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 12925 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgacagcgacgccaucuacucccccagcuuccagggccaggugaccaucuccgcggacaacagcaucuccacggccuaccugcaguggagcucccucaaggccagcgacaccgccaucuacuacugcgccuccgggcccggguacagcggcuaccacuacgggugguucgacaccuggggccagggcacccuggugacggucuccagcgcguccaccaaggggccgagcguguucccccuggcccccagcuccaagagcaccuccggcgggaccgccgcccucggcugccuggugaaggacuacuuccccgagccggucacggugagcuggaacuccggcgcgcugaccagcggggugcacaccuuccccgccguccuccaguccagcggccuguacucccugagcuccguggugaccguccccagcuccagccucgggacgcagaccuacaucugcaacgugaaccacaagcccuccaacaccaagguggacaagaaggucgagcccaagagcugcgacaagacccacacgugcccgcccugccccgccccggagcugcugggcgggcccuccguguuccucuucccgcccaagcccaaggacacccugaugaucagccggacccccgaggugaccugcgucgugguggacgucucccacgaggaccccgaggugaaguucaacugguacgucgacggcguggaggugcacaacgccaagacgaagccccgcgaggagcaguacaacagcaccuaccgggucgugagcgugcugaccguccuccaccaggacuggcugaacggcaaggaguacaagugcaagguguccaacaaggcccugccggcgcccaucgagaagaccaucagcaaggccaaggggcagccccgcgagccccagguguacacgcucccgcccucccgggaggagaugaccaagaaccaggucagccugaccugccuggugaagggcuucuaccccuccgacaucgccguggagugggagagcaacgggcagccggagaacaacuacaagaccacgccgcccguccucgacuccgacggcagcuucuuccuguacuccaagcugaccguggacaagagccgcuggcagcaggggaacguguucuccugcagcgucaugcacgaggcccuccacaaccacuacacccagaagucccugagccugucccccggcaag

SEQ ID NO: 12926 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgacaccgacacgaucuacagccccuccuuccagggccaggugaccaucagcgccgacaacuccaucagcaccgcguaccugcagugguccagccucaaggccuccgacaccgccaucuacuacugcgccagcgggcccggguacuccggcuaccacuacgggugguucgacacguggggccagggcacccuggugaccgucagcuccgccagcaccaaggggccguccguguucccccuggcgcccagcagcaaguccacgagcggcgggaccgccgcccucggcugccuggugaaggacuacuuccccgagccggucaccguguccuggaacagcggcgcccugaccuccggggugcacacguuccccgcgguccuccagagcuccggccuguacagccuguccagcguggugaccguccccuccagcucccucgggacccagaccuacaucugcaacgugaaccacaagcccagcaacacgaagguggacaagaaggucgagccgaaguccugcgacaagacccacacgugcccgcccugccccgcccccgagcugcugggcgggcccagcguguuccucuucccgcccaagcccaaggacacccugaugaucucccggacccccgaggugaccugcgucgugguggacgucagccacgaggaccccgaggugaaguucaacugguacgucgacggcguggaggugcacaacgccaagaccaagccccgcgaggagcaguacaacuccaccuaccgggucgugagcgugcugacgguccuccaccaggacuggcugaacggcaaggaguacaagugcaaggugagcaacaaggcccugccggcccccaucgagaagaccaucuccaaggcgaaggggcagccccgcgagccccagguguacacccucccgcccagccgggaggagaugaccaagaaccaggucucccugacgugccuggugaagggcuucuaccccagcgacaucgccguggagugggaguccaacgggcagccggagaacaacuacaagaccaccccgcccguccucgacagcgacggcuccuucuuccuguacagcaagcugaccguggacaagucccgcuggcagcaggggaacguguucagcugcuccgucaugcacgaggcccuccacaaccacuacacgcagaagucccugagccugagccccggcaag

SEQ ID NO: 12927 - RNA, 1359 nt, Artificial Sequence
  derived and/or modified sequence opt1 from anti-influenza_Chain
gaggugcagcugguccagagcggcgccgaggugaagaagcccggggagucccucaagaucagcugcaagguguccggcuacagcuucaccucccaguggaucggguggguccgccagaugcccggcaaggggcuggaguggaucggcaugauguaccccggcgagagcgacaccaucuacucccccagcuuccagggccaggugacgaucuccgccgacaacagcaucuccaccgcguaccugcaguggagcucccucaaggccagcgacaccgccaucuacuacugcgccuccgggcccggguacagcggcuaccacuacgggugguucgacaccuggggccagggcacgcuggugaccgucuccagcgccuccaccaaggggccgagcguguucccccuggcgcccagcuccaagagcaccuccggcgggacggccgcccucggcugccuggugaaggacuacuuccccgagccggucaccgugagcuggaacuccggcgcccugaccagcggggugcacaccuuccccgcgguccuccaguccagcggccuguacucccugagcuccguggugacgguccccagcuccagccucgggacccagaccuacaucugcaacgugaaccacaagcccuccaacaccaagguggacaagaaggucgagcccaagagcugcgacaagacgcacacgugcccgcccugccccgccccggagcugcugggcgggcccuccguguuccucuucccgcccaagcccaaggacacccugaugaucagccggacccccgaggugaccugcgucgugguggacgucucccacgaggaccccgaggugaaguucaacugguacgucgacggcguggaggugcacaacgccaagaccaagccccgcgaggagcaguacaacagcaccuaccgggucgugagcgugcugaccguccuccaccaggacuggcugaacggcaaggaguacaagugcaagguguccaacaaggcccugccggcccccaucgagaagacgaucagcaaggcgaaggggcagccccgcgagccccagguguacacccucccgcccucccgggaggagaugaccaagaaccaggucagccugaccugccuggugaagggcuucuaccccuccgacaucgccguggagugggagagcaacgggcagccggagaacaacuacaagacgaccccgcccguccucgacuccgacggcagcuucuuccuguacuccaagcugaccguggacaagagccgcuggcagcaggggaacguguucuccugcagcgucaugcacgaggcccuccacaaccacuacacccagaagucccugagccugucccccggcaag

SEQ ID NO: 12928 - RNA, 1359 nt, Artificial Sequence; identical to SEQ ID NO: 12916
  derived and/or modified sequence opt1 from anti-influenza_Chain

SEQ ID NO: 12929 - RNA, 1359 nt, Artificial Sequence; identical to SEQ ID NO: 12917
  derived and/or modified sequence opt1 from anti-influenza_Chain

SEQ ID NO: 12930 - RNA, 1359 nt, Artificial Sequence; identical to SEQ ID NO: 12918
  derived and/or modified sequence opt1 from anti-influenza_Chain

SEQ ID NO: 12931 - RNA, 1359 nt, Artificial Sequence; identical to SEQ ID NO: 12919
  derived and/or modified sequence opt1 from anti-influenza_Chain

SEQ ID NO: 12932 - RNA, 1359 nt, Artificial Sequence; identical to SEQ ID NO: 12920
  derived and/or modified sequence opt1 from anti-influenza_Chain

SEQ ID NO: 12933 - RNA, 1359 nt, Artificial Sequence; identical to SEQ ID NO: 12921
  derived and/or modified sequence opt1 from anti-influenza_Chain

SEQ ID NO: 12934 - RNA, 1359 nt, Artificial Sequence; identical to SEQ ID NO: 8665
  derived and/or modified sequence opt1 from anti-influenza_Chain

SEQ ID NO: 12935 - RNA, 1359 nt, Artificial Sequence; identical to SEQ ID NO: 12923
  derived and/or modified sequence opt1 from anti-influenza_Chain

SEQ ID NO: 12936 - RNA, 1359 nt, Artificial Sequence; identical to SEQ ID NO: 12924
  derived and/or modified sequence opt1 from anti-influenza_Chain

SEQ ID NO: 12937 - RNA, 1359 nt, Artificial Sequence; identical to SEQ ID NO: 12925
  derived and/or modified sequence opt1 from anti-influenza_Chain

SEQ ID NO: 12938 - RNA, 1359 nt, Artificial Sequence; identical to SEQ ID NO: 12926
  derived and/or modified sequence opt1 from anti-influenza_Chain

SEQ ID NO: 12939 - RNA, 1359 nt, Artificial Sequence; identical to SEQ ID NO: 12927
  derived and/or modified sequence opt1 from anti-influenza_Chain

SEQ ID NO: 12940 - RNA, 1365 nt, Artificial Sequence
  derived and/or modified sequence opt1 from anti-influenza_Chain
caggugcagcuggucgagagcggcgggggcguggugcagcccgggcgcucccuccggcugagcugcgccgccuccggcuucgcguuccacaaccgcgccaugcacuggguccggcaggccccggggaagggccuggaguggguggcccucaucuacuucgacggcagcaagcaguacuacgccgacuccgugaaggggcgcuucaccaucagccgggacaacuccaagaacaccgucuuccugcagaugaacagccugcgccccgaggacaccgcgguguacuacugcgccgugcccggccccaucuucgggaucuucccgcccugguccuacuucgaccacuggggccaggggauccucgucaccgugagcuccgccagcaccaagggccccuccguguucccccuggccccgagcuccaagagcaccuccggcgggacggcggcccugggcugccucgucaaggacuacuuccccgagcccgugaccgugagcuggaacuccggggcccugaccagcggcguccacaccuuccccgccgugcugcagagcuccggccucuacagccuguccagcguggucacggugccguccagcucccuggggacccagaccuacaucugcaacgugaaccacaagcccagcaacaccaaggucgacaagaagguggagcccaaguccugcgacaagacgcacacgugcccgcccugccccgcccccgagcuccugggcgggcccagcguguuccuguucccgcccaagcccaaggacacccucaugaucucccggacccccgaggugaccugcgucgucguggacgugagccacgaggacccggaggucaaguucaacugguacguggacggcguggagguccacaacgcgaagaccaagccccgcgaggagcaguacaacuccaccuaccggguggugagcguccugaccgugcugcaccaggacuggcucaacgggaaggaguacaagugcaagguguccaacaaggcccugcccgcccccaucgagaagacgaucagcaaggccaagggccagccgcgcgagccccaggucuacacccugcccccgucccgggaggagaugaccaagaaccaggugagccugaccugccucgugaagggcuucuaccccuccgacaucgccgucgagugggagagcaacgggcagcccgagaacaacuacaagacgacgcccccggugcuggacagcgacggcuccuucuuccucuacagcaagcugaccguggacaagucccgcuggcagcaggggaacgucuucagcugcuccgugaugcacgaggcgcugcacaaccacuacacccagaagucccucagccugagccccggcaag

SEQ ID NO: 12941 - RNA, 1365 nt, Artificial Sequence
  derived and/or modified sequence opt1 from anti-influenza_Chain
gaggugcagcuggucgagagcggcgggggcguggugcagcccgggcgcucccuccggcugagcugcgccgccuccggcuucgcguuccacaaccgcgccaugcacuggguccggcaggccccggggaagggccuggaguggguggcccucaucuacuucgacggcagcaagcaguacuacgccgacuccgugaaggggcgcuucaccaucagccgggacaacuccaagaacaccgucuuccugcagaugaacagccugcgccccgaggacaccgcgguguacuacugcgccgugcccggccccaucuucgggaucuucccgcccugguccuacuucgaccacuggggccaggggauccucgucaccgugagcuccgccagcaccaagggccccuccguguucccccuggccccgagcuccaagagcaccuccggcgggacggcggcccugggcugccucgucaaggacuacuuccccgagcccgugaccgugagcuggaacuccggggcccugaccagcggcguccacaccuuccccgccgugcugcagagcuccggccucuacagccuguccagcguggucacggugccguccagcucccuggggacccagaccuacaucugcaacgugaaccacaagcccagcaacaccaaggucgacaagaagguggagcccaaguccugcgacaagacgcacacgugcccgcccugccccgcccccgagcuccugggcgggcccagcguguuccuguucccgcccaagcccaaggacacccucaugaucucccggacccccgaggugaccugcgucgucguggacgugagccacgaggacccggaggucaaguucaacugguacguggacggcguggagguccacaacgcgaagaccaagccccgcgaggagcaguacaacuccaccuaccggguggugagcguccugaccgugcugcaccaggacuggcucaacgggaaggaguacaagugcaagguguccaacaaggcccugcccgcccccaucgagaagacgaucagcaaggccaagggccagccgcgcgagccccaggucuacacccugcccccgucccgggaggagaugaccaagaaccaggugagccugaccugccucgugaagggcuucuaccccuccgacaucgccgucgagugggagagcaacgggcagcccgagaacaacuacaagacgacgcccccggugcuggacagcgacggcuccuucuuccucuacagcaagcugaccguggacaagucccgcuggcagcaggggaacgucuucagcugcuccgugaugcacgaggcgcugcacaaccacuacacccagaagucccucagccugagccccggcaag

SEQ ID NO: 12942 - RNA, 1365 nt, Artificial Sequence
  derived and/or modified sequence opt1 from anti-influenza_Chain
gaggugcagcugguccagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcuccgccagcacgaagggccccuccguguucccccuggccccgagcuccaagagcaccuccggcgggaccgccgcgcucggcugccuggugaaggacuacuuccccgagcccgucaccgugagcuggaacagcggggcccugacguccggcgugcacaccuuccccgccguccuccagagcuccggccuguacagccuguccagcguggugaccgucccguccagcucccucgggacccagacguacaucugcaacgugaaccacaagcccagcaacaccaagguggacaagaaggucgagcccaaguccugcgacaagacccacacgugcccgcccugccccgcccccgagcugcugggcgggcccagcguguuccucuucccgcccaagcccaaggacacccugaugaucucccggacccccgaggugaccugcgucguggucgacgugagccacgaggacccggaggugaaguucaacugguacgucgacggcguggaggugcacaacgccaagaccaagccccgcgaggagcaguacaacuccacguaccgggucgugagcgugcugaccguccuccaccaggacuggcugaacgggaaggaguacaagugcaagguguccaacaaggcgcugcccgcccccaucgagaagaccaucagcaaggccaagggccagccgcgcgagccccagguguacacccucccgcccucccgggaggagaugacgaagaaccaggucagccugaccugccuggugaagggcuucuaccccagcgacaucgccguggagugggaguccaacgggcagcccgagaacaacuacaagaccacgcccccgguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 12943 - RNA, 1365 nt, Artificial Sequence
  derived and/or modified sequence opt1 from anti-influenza_Chain
caggugcagcuggucgagagcggcgggggcguggugcagcccgggaagucccuccgccugagcugcgccgccuccggccugaccuucagcuccuacgcgguccacugggugcggcaggccccggggaagggccucgagugggugacccugaucagcuacgacggcgccaaccaguacuacgccgacuccgucaaggggcgcuucacgaucagccgggacaacuccaagaacaccguguaccugcagaugaacagccuccgccccgaggacaccgccguguacuacugcgcgguccccggccccguguucgggaucuucccgcccugguccuacuucgacaacuggggccaggggauccuggugaccgucagcuccgccagcacgaagggccccuccguguucccccuggccccgagcuccaagagcaccuccggcgggaccgccgcgcucggcugccuggugaaggacuacuuccccgagcccgucaccgugagcuggaacagcggggcccugacguccggcgugcacaccuuccccgccguccuccagagcuccggccuguacagccuguccagcguggugaccgucccguccagcucccucgggacccagacguacaucugcaacgugaaccacaagcccagcaacaccaagguggacaagaaggucgagcccaaguccugcgacaagacccacacgugcccgcccugccccgcccccgagcugcugggcgggcccagcguguuccucuucccgcccaagcccaaggacacccugaugaucucccggacccccgaggugaccugcgucguggucgacgugagccacgaggacccggaggugaaguucaacugguacgucgacggcguggaggugcacaacgccaagaccaagccccgcgaggagcaguacaacuccacguaccgggucgugagcgugcugaccguccuccaccaggacuggcugaacgggaaggaguacaagugcaagguguccaacaaggcgcugcccgcccccaucgagaagaccaucagcaaggccaagggccagccgcgcgagccccagguguacacccucccgcccucccgggaggagaugacgaagaaccaggucagccugaccugccuggugaagggcuucuaccccagcgacaucgccguggagugggaguccaacgggcagcccgagaacaacuacaagaccacgcccccgguccucgacagcgacggcuccuucuuccuguacagcaagcugaccguggacaagucccgcuggcagcaggggaacguguucagcugcuccgucaugcacgaggcccuccacaaccacuacacccagaagucccugagccugagccccggcaag

SEQ ID NO: 12944 - RNA, 1365 nt, Artificial Sequence
  derived and/or modified sequence opt1 from anti-influenza_Chain
caggugcagcuggucgagagcggcgggggcguggugcagcccgggaaguccccgcgccucagcugcgccgccuccggccccaccuucagcuccuacgcgguccacugggugcggcaggcccccgggaagggccuggagugggugacccugaucagcuacgacggcgccaaccaguacuacgccgacuccgucaaggggcgcuucacgaucagccgggacaacuccaagaacaccguguaccuccagaugaacagccugcgccccgaggacaccgccguguacuacugcgcgguccccggccccguguucgggaucuucccgcccugguccuacuucgacaacuggggccaggggauccuggugaccgucagcuccgccagcacgaagggcccguccguguucccccucgcccccagcuccaagagcaccuccggcgggaccgccgcgcugggcugccuggugaaggacuacuuccccgagccggucaccgugagcuggaacagcggggcccucacguccggcgugcacaccuuccccgccguccugcagagcuccggccuguacagccucuccagcguggugaccguccccuccagcucccuggggacccagacguacaucugcaacgugaaccacaagcccagcaacaccaagguggacaagaaggucgagccgaaguccugcgacaagacccacacgugcccgcccugccccgcccccgagcugcucggcgggcccagcguguuccuguucccgcccaagcccaaggacacccugaugaucucccggacccccgaggugaccugcgucguggucgacgugagccacgaggaccccgaggugaaguucaacugguacgucgacggcguggaggugcacaacgccaagaccaagccccgcgaggagcaguacaacuccacguaccgggucgugagcgugcucaccguccugcaccaggacuggcugaacgggaaggaguacaagugcaagguguccaacaaggcgcucccggcccccaucgagaagaccaucagcaaggccaagggccagccccgcgagccccagguguacacccugccgcccucccgggaggagaugacgaagaaccaggucagccugaccugccucgugaagggcuucuaccccagcgacaucgccguggagugggaguccaacgggcagcccgagaacaacuacaagaccaccccgcccguccuggacagcgacggcuccuucuuccuguacagcaagcucacgguggacaagucccgcuggcagcaggggaacguguucagcugcuccgucaugcacgaggcccugcacaaccacuacacccagaagucccugagccucagccccggcaag

SEQ ID NO: 12945 - RNA, 1365 nt, Artificial Sequence; identical to SEQ ID NO: 8649
  derived and/or modified sequence opt1 from anti-influenza_Chain

SEQ ID NO: 12946 - RNA, 1365 nt, Artificial Sequence
  derived and/or modified sequence opt1 from anti-influenza_Chain
caggugcagcugguccagagcggcgccgagcucaagcgccccggggccuccgugaaggugagcugcaagaccuccggcuacagcuucaacaacuacgggaucaacuggguccggcaggcgccgggccaggggcuggaguggaugggcuggaucuccgccuacaccggcaacacccacuacgccaagaacuucgaggggcgcgugacccugaccaccgacacgagcaccuccaccgccuacauggaggugcggagccuccgcuccgacgacagcgccgucuacuucugcgcgcgggccaugauccagggcguggugacccuguaccugcgccccggggacuacuggggccaggggacgcucgucaccguguccagcgccuccaccaagggccccagcguguucccccuggccccguccagcaaguccaccagcggcgggacggcggcccugggcugccucgucaaggacuacuuccccgagcccgugaccguguccuggaacagcggggcccugaccagcggcguccacaccuuccccgccgugcugcaguccagcggccucuacucccugagcuccguggucacggugccgagcuccagccuggggacccagaccuacaucugcaacgugaaccacaagcccuccaacaccaaggucgacaagaagguggagcccaagagcugcgacaagacgcacacgugcccgcccugccccgcccccgagcuccugggcgggcccuccguguuccuguucccgcccaagcccaaggacacccucaugaucagccggacccccgaggugaccugcgucgucguggacgugucccacgaggacccggaggucaaguucaacugguacguggacggcguggagguccacaacgcgaagaccaagccccgcgaggagcaguacaacagcaccuaccgggugguguccguccugaccgugcugcaccaggacuggcucaacgggaaggaguacaagugcaaggugagcaacaaggcccugcccgcccccaucgagaagacgaucuccaaggccaagggccagccgcgcgagccccaggucuacacccugccgcccagccgggaggagaugaccaagaaccaggugucccugaccugccucgugaagggcuucuaccccagcgacaucgccgucgagugggagagcaacgggcagcccgagaacaacuacaagacgacgcccccggugcuggacuccgacggcagcuucuuccucuacuccaagcugaccguggacaagagccgcuggcagcaggggaacgucuucuccugcagcgugaugcacgaggcgcugcacaaccacuacacccagaagucccucagccugucccccggcaag

SEQ ID NO: 12947 - RNA, 1365 nt, Artificial Sequence; identical to SEQ ID NO: 12940
  derived and/or modified sequence opt1 from anti-influenza_Chain

SEQ ID NO: 12948 - RNA, 1365 nt, Artificial Sequence; identical to SEQ ID NO: 12941
  derived and/or modified sequence opt1 from anti-influenza_Chain

SEQ ID NO: 12949 - RNA, 1365 nt, Artificial Sequence; identical to SEQ ID NO: 12942
  derived and/or modified sequence opt1 from anti-influenza_Chain

SEQ ID NO: 12950 - RNA, 1365 nt, Artificial Sequence; identical to SEQ ID NO: 12943
  derived and/or modified sequence opt1 from anti-influenza_Chain

SEQ ID NO: 12951 - RNA, 1365 nt, Artificial Sequence; identical to SEQ ID NO: 12944
  derived and/or modified sequence opt1 from anti-influenza_Chain

SEQ ID NO: 12952 - RNA, 1365 nt, Artificial Sequence; identical to SEQ ID NO: 8649
  derived and/or modified sequence opt1 from anti-influenza_Chain

SEQ ID NO: 12953 - RNA, 1365 nt, Artificial Sequence; identical to SEQ ID NO: 12946
  derived and/or modified sequence opt1 from anti-influenza_Chain

SEQ ID NO: 12954 - RNA, 1368 nt, Artificial Sequence
  derived and/or modified sequence opt1 from anti-influenza_Chain
gaggugcagcugguccagagcggcgggggcguggugcagccccgccggucccuccgccugagcugcgccgccuccggguucaccuucagcuccuacgcgaugcacuggguccggcaggccccgggcaaggggcuggaguggguggccgugaucagcuacgacggccgcaacaaguacuacgccgacuccgucaagggccgguucaccgugagccgcgacaacuccaagaacacgcucuaccugcagaugaacagccugcgggccgaggacaccuccguguacuacugcgcgcgcgagcuccugauggacuacuacgaccacaucggguacagccccggccccaccugggggcagggcacccuggucacgguguccagcgccuccaccaaggggcccagcguguucccgcucgcccccuccagcaaguccaccagcggcggcaccgccgcgcuggggugccuggucaaggacuacuuccccgagcccgugacggugagcuggaacuccggcgcccucaccagcgggguccacaccuucccggccgugcugcaguccagcggccuguacucccucagcuccguggucaccgugcccagcuccagccugggcacgcagaccuacaucugcaacgugaaccacaagcccuccaacaccaaggucgacaagcggguggagcccaagagcugcgacaagacccacacgugcccgcccugccccgcccccgagcugcucgggggcccguccguguuccuguucccgcccaagcccaaggacacccugaugaucagccgcacccccgaggugaccugcgucgucguggacgugucccacgaggaccccgaggucaaguucaacugguacguggacgggguggagguccacaacgccaagacgaagccccgggaggagcaguacaacagcaccuaccgcgugguguccguccucaccgugcugcaccaggacuggcugaacggcaaggaguacaagugcaaggugagcaacaaggcgcuccccgccccgaucgagaagaccaucuccaaggccaaggggcagccccgggagccccaggucuacacgcugcccccgagccgcgaggagaugaccaagaaccaggugagccugaccugccucgugaagggcuucuaccccuccgacaucgccgucgagugggagagcaacggccagcccgagaacaacuacaagaccacgccgcccgugcuggacuccgacgggagcuucuuccuguacuccaagcucaccguggacaagagccgguggcagcagggcaacgucuucuccugcagcgugaugcacgaggcccugcacaaccacuacacccagaagucccugagccucucccccgggaag

SEQ ID NO: 12955 - RNA, 1371 nt, Artificial Sequence
  derived and/or modified sequence opt1 from anti-influenza_Chain
auggugauccagcgcaacagcauccugcuccugaucaucaucuucgccuccagcaucuccacgugccggagcaacgucaucgacgacaaccuguucaagcaggucuacgacaacauccucgagcaggaguucgcccacgacuuccaggccuaccuguccuaccugagcaagaacaucgaguccaacaacaacaucgacaagguggacaagaacggcaucaaggugaucaacgugcucagcuucggggccaagggcgacgggaagaccuacgacaacaucgccuucgagcaggccuggaacgaggccugcuccagccgcacccccgugcaguucgucgugccgaagaacaagaacuaccugcugaagcagaucaccuucuccggccccugccggagcuccaucagcgugaagaucuucgggucccucgaggcgagcuccaagaucagcgacuacaaggaccgccggcuguggaucgccuucgacuccguccagaaccugguggugggcggcgggggcaccaucaacgggaacggccaggucugguggcccagcagcugcaagaucaacaagucccuccccugccgcgacgccccgaccgcccugaccuucuggaacugcaagaaccugaaggugaacaaccucaagagcaagaacgcgcagcagauccacaucaaguucgaguccugcaccaacguggucgccagcaaccugaugaucaacgccuccgccaagagccccaacaccgacggggugcacguguccaacacccaguacauccagaucagcgacacgaucaucggcaccggcgacgacugcaucuccaucgucagcgggucccagaacgugcaggccaccaacaucacgugcggccccgggcacggcaucagcaucggcucccuggggagcggcaacuccgaggcguacgugagcaacgucaccgugaacgaggccaagaucaucggggccgagaacggcgugcggaucaagaccuggcagggcggguccggccaggccagcaacaucaaguuccucaacgucgagaugcaggacgugaaguaccccaucaucaucgaccagaacuacugcgaccgcgucgagccgugcauccagcaguucuccgccguccaggugaagaacgugguguacgagaacaucaaggggaccagcgcgaccaagguggccaucaaguucgacugcagcacgaacuuccccugcgagggcaucaucauggagaacaucaaccuggucggggaguccggcaagcccagcgaggcgaccugcaagaacgugcacuucaacaacgccgagcacgugacgccccacugcaccucccuggagaucagcgaggacgaggcccuccuguacaacuac

SEQ ID NO: 12956 - RNA, 1371 nt, Artificial Sequence; identical to SEQ ID NO: 12955
  derived and/or modified sequence opt1 from anti-influenza_Chain

SEQ ID NO: 12957 - RNA, 1380 nt, Artificial Sequence
  derived and/or modified sequence opt1 from anti-influenza_Chain
augaagcuguggcucaacuggaucuuccuggugacccugcucaacgacauccagugcgaggucaagcugguggagagcggcgggggccuggugcagcccgggggcucccuccgccugagcugcgccaccuccggguucaccuucagcgacuacuacauguccuggguccggcagagcccgggcaaggcccuggaguggcucggcuucacccgcucccgggugcugggguacaccaccgacuacagcgcguccgugaagggccgcuucacgaucagccgggacaacucccagagcauccuguaccuccagaugaacucccugcgcggggaggacagcgccaccuacuacugcgcccgggaccgccccauggacuacuggggccaggggaccuccgucaccgugagcuccgccaagacgaccccgcccagcguguacccccuggcccccggcuccgcggcccagaccaacagcauggucacccucggcugccuggugaagggguacuuccccgagcccgugacggucaccuggaacagcggcucccugagcuccggggugcacaccuucccggccgugcuccagagcgaccuguacacccuguccagcuccgucacggugcccagcuccaccuggcccagcgagaccgugaccugcaacgucgcccaccccgcguccagcacgaagguggacaagaagaucgugccgcgggacugcggcugcaagcccugcaucugcaccguccccgagguguccagcguguucaucuucccgcccaagcccaaggacguccucaccaucacccugacgcccaaggugaccugcgucgugguggacaucuccaaggacgaccccgagguccaguucagcugguucguggacgacguggagguccacaccgcccagacccagccgcgcgaggagcaguucaacuccacguuccggagcguguccgagcugcccaucaugcaccaggacuggcucaacggcaaggaguucaagugccgcgugaacagcgccgccuuccccgcccccaucgagaagaccaucagcaagaccaaggggcggccgaaggcgccccaggucuacaccaucccgccgcccaaggagcagauggccaaggacaaggugucccugacgugcaugaucaccgacuucuuccccgaggacaucaccguggaguggcaguggaacggccagcccgccgagaacuacaagaacacccagcccaucauggacacggacgggagcuacuucgucuacuccaagcugaacgugcagaaguccaacugggaggccggcaacaccuucacgugcagcgugcuccacgaggggcugcacaaccaccacaccgagaagucccugagccacagccccggcaag

SEQ ID NO: 12958 - RNA, 1380 nt, Artificial Sequence; identical to SEQ ID NO: 12957
  derived and/or modified sequence opt1 from anti-influenza_Chain

SEQ ID NO: 12959 - RNA, 1386 nt, Artificial Sequence
  derived and/or modified sequence opt1 from anti-influenza_Chain
auggaguggagcuggaucuuccuguuccuccuguccggcaccgccggggugcacagcgagguccagcugcagcaguccggccccgagcucgugaagccgggggccagcgugaagauguccugcaaggcgagcggcuacaccuucaccuccuacgucaugcacugggugaagcagaagcccgggcagggccuggaguggaucggcuacaucaaccccuacaacgacgggacccgcuacaacgagaaguuccgggugaaggccacccugaccagcgacaaguccagcuccacggccuacauggagcucagcucccugaccagcgaggacuccgccgucuacuacugcgcccgccggggccugaucaccacccccacgcucgacuacugggggcagggcaccacccugaccgugagcuccgcgaagacgaccccgcccagcguguacccccuggcccccggguccgccgcccagaccaacagcauggucacccucggcugccuggugaagggcuacuucccggagcccgugacggucaccuggaacagcgggucccugagcuccggcgugcacaccuuccccgcggugcuccagagcgaccuguacacccuguccagcuccgucacggugcccagcuccaccuggccgagcgagaccgugaccugcaacgucgcccaccccgccuccagcacgaagguggacaagaagaucgugccccgcgacugcgggugcaagcccugcaucugcaccgucccggagguguccagcguguucaucuucccgcccaagcccaaggacguccucaccaucacccugacgcccaaggugaccugcgucgugguggacaucuccaaggacgaccccgagguccaguucagcuggguggacgacguggagguccacaccgcccagacccagccccgggaggagcaguucaacuccacguuccgcagcguguccgagcugcccaucaugcaccaggacuggcucaacggcaaggaguucaagugccgggugaacagcgccgcguucccggcccccaucgagaagaccaucagcaagaccaagggccgccccaaggcgccccaggucuacaccaucccgccgcccaaggagcagauggccaaggacaaggugucccugacgugcaugaucaccgacuucuuccccgaggacaucaccguggaguggcaguggaacgggcagcccgccgagaacuacaagaacacccagcccaucauggacaccgacggcagcuacuucgucuacuccaagcugaacgugcagaaguccaacugggaggccgggaacacguucacgugcagcgugcuccacgagggccugcacaaccaccacaccgagaagucccugagccacagccccgggaag

SEQ ID NO: 12960 - RNA, 1386 nt, Artificial Sequence
  derived and/or modified sequence opt1 from anti-influenza_Chain
caggugcagcugguccagagcggcgccgaggugaagaagcccggggccuccgugaaggucagcugcaagaccuccggcuacaccuucacggcguacaccauccacugggugcgccaggccccggggcagcggcucgaguggaugggcuggaucaacgccgggaacggccacaccaaguacagccagcgcuucaagggccgggugaccaucacgcgcgacaccuccgcccggaccaccuacauggagcugcgcagccugacguccgaggacaccgcccucuacuucugcgcgcgggggcccgagaccuacuacuacgacaagaccaacuggcugaacagccaccccgacgaguacuuccagcacuggggccacgggacgcaggucaccguguccagcgccuccaccaagggccccagcguguucccgcuggcccccuccagcaaguccaccagcgggggcacggccgcgcucggcugccuggucaaggacuacuuccccgagcccgugaccguguccuggaacagcggggcccugaccuccggcguccacaccuucccggccgugcuccagagcagcgggcuguacucccugagcuccguggucacggugcccagcuccagccucggcacccagaccuacaucugcaacgugaaccacaagcccuccaacaccaaggucgacaagaagguggagcccaagagcugcgacaagacgcacacgugcccgcccugccccgcccccgagcugcugggcgggccguccguguuccucuucccgcccaagcccaaggacacccugaugaucagccgcacccccgaggugaccugcgucguggucgacgugucccacgaggaccccgaggucaaguucaacugguacguggacggcguggagguccacaacgccaagaccaagccccgggaggagcaguacaacagcaccuaccgcgugguguccguccugaccgugcuccaccaggacuggcugaacgggaaggaguacaagugcaaggugagcaacaaggcgcugcccgccccgaucgagaagacgaucuccaaggccaagggccagccccgggagccccaggucuacacccugcccccgagccgcgacgagcucaccaagaaccaggugucccugaccugccucgugaagggguucuaccccagcgacaucgccgucgagugggaguccaacggccagcccgagaacaacuacaagacgaccccgcccgugcuggacagcgacggcagcuucuuccuguacuccaagcucaccguggacaagagccgguggcagcaggggaacgucuucuccugcagcgugaugcacgaggcccugcacaaccacuacacccagaagucccugagccucucccccggcaag

SEQ ID NO: 12961 - RNA, 1386 nt, Artificial Sequence; identical to SEQ ID NO: 12960
  derived and/or modified sequence opt1 from anti-influenza_Chain

SEQ ID NO: 12962 - RNA, 1386 nt, Artificial Sequence; identical to SEQ ID NO: 12959
  derived and/or modified sequence opt1 from anti-influenza_Chain

SEQ ID NO: 12963 - RNA, 1398 nt, Artificial Sequence
  derived and/or modified sequence opt1 from anti-influenza_Chain
augcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaaccacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuacaacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaaguggcugggcggcaucaagggcggguucgugcaccagcggauggccagcaagaucgggcgcugguacucccggaccaugagcaagaccaaccgcaugggcauggagcucuacgugaaguacgacggggaccccuggaccgacuccgacgcccugacccugagcggcgucaugguguccaucgaggagcccggcugguacagcuucggguucgagaucaaggacaagaagugcgacgugccgugcaucggcaucgagaugguccacgacgggggcaaggacaccuggcacuccgcggccaccgccaucuacugccucauggggagcggccagcugcugugggacacggugaccggcguggacauggcccuc

SEQ ID NO: 12964 - RNA, 1398 nt, Artificial Sequence; identical to SEQ ID NO: 12963
  derived and/or modified sequence opt1 from anti-influenza_Chain

SEQ ID NO: 12965 - RNA, 1407 nt, Artificial Sequence
  derived and/or modified sequence opt1 from anti-influenza_Chain
auggacuggaccuggcgcuuccuguucguggucgccgccgcgaccggcgugcagagccaggugcagcucguccaguccggggccgaggugaagaagcccggcagcuccgugaaggucagcugcaaggccuccgggggcacgcugaacaacuacgccaucagcugggugcggcaggccccggggcagggccuggaguggaugggcgggaucucccccaucuucggcacccucaacuacgcggagcgcuuccaggggcgggugaccaucaccgccgacgucuucacgaacaccguguacauggagcugagcucccugcgcagcgaggacaccgccguguacuucugcgcccggggcugcggguacaacugcuacuacuucgacggcuggggccaggggacccucgucacgguguccagcgcguccaccaagggccccagcguguucccccuggccccguccagcaaguccaccagcgggggcaccgccgcccugggcugccucgucaaggacuacuuccccgagcccgugacgguguccuggaacagcggggcccugaccagcggcguccacaccuuccccgcggugcugcaguccagcgggcucuacucccugagcuccguggucaccgugccgagcuccagccugggcacgcagaccuacaucugcaacgugaaccacaagcccuccaacaccaaggucgacaagaagguggagcccaagagcugcgacaagacccacacgugcccgcccugccccgcccccgagcuccucgggggccccuccgucuuccuguucccgcccaagcccaaggacacccugaugaucagccgcacccccgaggugaccugcguggucguggacgugucccacgaggacccggaggucaaguucaacugguacguggacggcguggagguccacaacgccaagacgaagccccgggaggagcaguacaacagcaccuaccgcgugguguccguccugaccgugcugcaccaggacuggcucaacgggaaggaguacaagugcaaggugagcaacaaggcccugcccgcccccaucgagaagaccaucuccaaggcgaagggccagccgcgggagccccaggucuacacgcugccgcccagccgcgacgagcucaccaagaaccaggugucccugaccugccuggugaagggguucuaccccagcgacaucgccgucgagugggagagcaacggccagcccgagaacaacuacaagaccacgcccccggugcucgacuccgacgggagcuucuuccuguacuccaagcugaccguggacaagagccgguggcagcagggcaacgucuucuccugcagcgugaugcacgagggccuccacaaccacuacacccagaagucccugagccugucccccgggaag

SEQ ID NO: 12966 - RNA, 1407 nt, Artificial Sequence; identical to SEQ ID NO: 12965
  derived and/or modified sequence opt1 from anti-influenza_Chain

SEQ ID NO: 12967 - RNA, 1407 nt, Artificial Sequence; identical to SEQ ID NO: 12965
  derived and/or modified sequence opt1 from anti-influenza_Chain

SEQ ID NO: 12968 - RNA, 1413 nt, Artificial Sequence
  derived and/or modified sequence opt1 from anti-influenza_Chain
gacggcgugaagccccugauccuccgcgacugcagcgucgccggguggcugcugggcaacccgaugugcgacgaguucaucaacgugcccgagugguccuacaucguggagaaggccaaccccgcgaacgaccucugcuaccccgggaacuucaacgacuacgaggagcugaagcaccuccucagccggaucaaccacuucgagaagauccagaucaucccgaaguccagcugguccgaccacgaggccagcuccggcgucagcuccgccugccccuaccaggggacccccagcuucuuccgcaacgugguguggcugaucaagaagaacaacaccuaccccacgaucaagcgguccuacaacaacaccaaccaggaggaccugcucauccuguggggcauccaccacagcaacgacgccgccgagcagaccaagcuguaccagaacccgaccacguacaucuccgucggcaccagcacccucaaccagcgccuggugcccaagaucgcgacccgguccaaggugaacgggcagaacggccgcauggacuucuucuggacgauccugaagcccaacgacgccaucaacuucgagagcaacgggaacuucaucgcccccgaguacgccuacaagaucgucaagaagggcuacaucccggaggcgccccgggacgggcaggccuacgugcgcaaggacggcgagugggugcuccuguccaccuuccugcggagcgacaagacccacacgugcccgcccugcccggcccccgagcuccugggcgggcccuccgucuuccuguucccgcccaagcccaaggacacccucaugaucagccgcacccccgaggugaccugcguggucguggacgugagccacgaggaccccgaggucaaguucaacugguacguggacggcguggagguccacaacgccaagaccaagccgcgggaggagcaguacaacuccacguaccgcguggugagcguccugaccgugcugcaccaggacuggcucaacgggaaggaguacaagugcaaggucuccaacaaggcccugcccgcgcccaucgagaagaccaucagcaaggccaagggccagccccgggagccccagguguacacccugccgcccucccgcgaggagaugacgaagaaccaggugagccugaccugccuggucaagggcuucuaccccuccgacaucgccguggagugggagagcaacgggcagcccgagaacaacuacaagaccaccccgcccgugcuggacuccgacggcagcuucuuccucuacuccaagcugacggucgacaagagccgguggcagcaggggaacguguucuccugcagcgugaugcacgaggcccugcacaaccacuacacccagaagucccucagccugucccccggcaag

SEQ ID NO: 12969 - RNA, 1413 nt, Artificial Sequence; identical to SEQ ID NO: 12968
  derived and/or modified sequence opt1 from anti-influenza_Chain

SEQ ID NO: 12970 - RNA, 1416 nt, Artificial Sequence
  derived and/or modified sequence opt1 from anti-influenza_Chain
auggacuggaccuggcgcuuccuguucguggucgccgccgcgaccggcgugcagugccaggugcagcucguccagagcggggccgaggugaagaugcccggcuccagcgugaaggucuccugcaagacgagcgggguguucuucuccagccacgccaucuccugggugcggcaggcccccggccaggggcuggaguggaugggcggcaucagccccauguucgggaccacccacuacgcccagaaguuccagggccgcgucaccaucacggcggaccaguccaccaccaccgccuacauggagcugacgagccucaccuccgaggacaccgccguguacuacugcgcccgggacggggcgggcagcuacuacccccugaacugguucgaccccugggggcagggcacccuggugacggucuccagcgccuccaccaagggcccgagcguguucccccucgcccccuccagcaaguccaccagcgggggcaccgccgcccuggggugccuggugaaggacuacuuccccgagccggucacggugagcuggaacuccggcgcgcucaccagcggcgugcacaccuuccccgccguccugcaguccagcgggcuguacucccucagcuccguggugaccguccccagcuccagccugggcacgcagaccuacaucugcaacgugaaccacaagcccuccaacaccaagguggacaagcgcgucgagcccaagagcugcgacaagacccacacgugcccgcccugccccgccccggagcugcucgggggccccuccguguuccuguucccgcccaagcccaaggacacccugaugaucagccggacccccgaggugaccugcgucguggucgacgugucccacgaggaccccgaggugaaguucaacugguacgucgacgggguggaggugcacaacgccaagacgaagccccgcgaggagcaguacaacagcaccuaccgggucguguccgugcucaccguccugcaccaggacuggcugaacggcaaggaguacaagugcaaggugagcaacaaggcccucccggcgcccaucgagaagaccaucuccaaggccaagggccagccccgcgagccccagguguacacgcugccgcccagccgggacgagcugaccaagaaccaggucagccugaccugccucgugaagggguucuaccccuccgacaucgccguggagugggagagcaacggccagccggagaacaacuacaagaccacgccgcccguccuggacuccgacgggagcuucuuccucuacuccaagcugaccguggacaagagccgcuggcagcagggcaacguguucuccugcagcgucaugcacgaggggcugcacaaccacuacacccagaagucccucagccugucccccggcaag

SEQ ID NO: 12971 - RNA, 1416 nt, Artificial Sequence; identical to SEQ ID NO: 12970
  derived and/or modified sequence opt1 from anti-influenza_Chain

SEQ ID NO: 12972 - RNA, 1416 nt, Artificial Sequence; identical to SEQ ID NO: 12970
  derived and/or modified sequence opt1 from anti-influenza_Chain

SEQ ID NO: 12973 - RNA, 1419 nt, Artificial Sequence
  derived and/or modified sequence opt1 from anti-influenza_Chain
augaccgagagcgccaugaccucccgcgccggccgggggcgcggcgcggaccugguggccgccgucgugcaggggcacgccgccgcgagcgacgccgccggcgaccucuccuuccccgacggguucaucuggggcgccgcgacggccgccuaccagaucgagggcgccuggcgggaggacgggcgcggccugugggacguguucagccacaccccggggaaggucgccuccggccacaccggggacaucgcgugcgaccacuaccaccgguacgccgacgacgugcgccugauggccggccucggcgaccggguguaccgcuucagcgucgccuggccccggaucgugcccgacggguccggccccgugaacccggccgggcuggacuucuacgaccgccuggucgacgagcuccugggccacggcaucacccccuaccccacgcuguaccacugggaccucccccagacccuggaggaccgcgggggcugggcggcccgggacaccgccuaccgguucgccgaguacgcccuggcggugcaccgccggcucggggaccgcgugcggugcuggaucacccugaacgagccgugggucgccgccuuccuggccacgcaccgcggcgcccccggggcggccgacgugccccgguuccgcgccgugcaccaccuccugcugggccacggccucgggcugcggcugcgcagcgccggcgcggggcagcucggccugacccugucccucagccccgucaucgaggcccgcccgggggugcggggcggcgggcgccggguggacgcccuggccaaccgccaguuccuggaccccgcccuccggggccgcuaccccgaggagguccugaagaucauggcggggcacgcccggcugggccaccccgggcgcgaccucgagaccauccaccagccgguggaccugcugggcgugaacuacuacucccacguccggcucgccgccgagggcgagcccgccaaccgccugcccgggagcgagggcauccgguucgagcgccccaccgcggugacggccuggccgggggaccggcccgacggccugcgcacccuccugcugcggcucucccgcgacuaccccggcguggggcugaucaucaccgagaacggcgccgccuucgacgaccgggccgacggggaccgcguccacgaccccgagcggauccgcuaccugaccgcgacgcuccgcgccgugcacgacgccaucauggccggcgcggaccugcggggguacuucgucuggagcgugcuggacaacuucgagugggccuacggcuaccacaagcgcggcaucguguacgucgacuacaccaccaugcggcgcaucccgcgggaguccgcccucugguaccgcgacguggugcggcgcaacgggcugcggaacggcgag

SEQ ID NO: 12974 - RNA, 1419 nt, Artificial Sequence; identical to SEQ ID NO: 12973
  derived and/or modified sequence opt1 from anti-influenza_Chain

SEQ ID NO: 12975 - RNA, 1422 nt, Artificial Sequence
  derived and/or modified sequence opt1 from anti-influenza_Chain
cugagccgcaucaaccacuucgagaagauccagaucauccccaaguccagcugguccgaccacgaggccagcuccggcgugagcuccgccugcccguaccaggggacccccagcuucuuccggaacgucguguggcucaucaagaagaacaacaccuaccccacgaucaagcgcuccuacaacaacaccaaccaggaggaccugcugauccucuggggcauccaccacagcaacgacgcggccgagcagaccaagcuguaccagaaccccaccacguacaucuccguggggaccagcacccugaaccagcggcucgucccgaagaucgccacccgcuccaaggugaacggccagaacgggcggauggacuucuucuggacgauccugaagcccaacgacgccaucaacuucgagagcaacggcaacuucaucgcccccgaguacgcguacaagaucgugaagaagggcgacuccgccaucgucaagagcgagguggaguacgggaacugcaacaccaagugccagacccccaucggcgccaucaacuccagcaugccguuccacaacauccacccccugaccaucggggagugccccaaguacgugaaguccaacaagcucguccuggccacgggccugcgcaacagcccccucggguacaucccggaggcgccccgggacggccaggccuacgugcgcaaggacggcgagugggugcugcugagcaccuuccuccgguccgacaagacccacacgugcccgcccugcccggcccccgagcugcucgggggccccagcgucuuccuguucccgcccaagcccaaggacacccugaugaucucccgcacccccgaggugaccugcguggucguggacgugagccacgaggaccccgaggucaaguucaacugguacguggacgggguggagguccacaacgccaagaccaagccgcgggaggagcaguacaacuccacguaccgcguggugagcguccugaccgugcuccaccaggacuggcugaacggcaaggaguacaagugcaaggucuccaacaaggcccugcccgcgcccaucgagaagaccaucagcaaggccaagggccagccccgggagccccagguguacacccucccgcccucccgcgaggagaugacgaagaaccaggugagccugaccugccuggucaagggguucuaccccuccgacaucgccguggagugggagagcaacggccagcccgagaacaacuacaagaccaccccgcccgugcucgacuccgacgggagcuucuuccuguacuccaagcugacggucgacaagagccgguggcagcagggcaacguguucuccugcagcgugaugcacgaggcccuccacaaccacuacacccagaagucccugagccugagccccgggaag

SEQ ID NO: 12976 - RNA, 1422 nt, Artificial Sequence; identical to SEQ ID NO: 12975
  derived and/or modified sequence opt1 from anti-influenza_Chain

SEQ ID NO: 12977 - RNA, 1428 nt, Artificial Sequence
  derived and/or modified sequence opt1 from anti-influenza_Chain
auggaguucggccugagcuggguguuccucgucgcccugcugcgcggggugcagugccaggugcagcucgucgaguccggcgggggcguggugcagcccgggcggagccugcgccuguccugcgccgcgagcggcuucaccuucucccgguucggcauccacuggguccgccaggccccggggaagggccucgaguggauggccgugaucugguacgacgggagcaacaaguucuacgccgacuccgugaagggccgguucaccaucagccgcgacaacuccaagaacacggucuaccugcagaugaacagccugcgggccgaggacaccgcgguguacuacugcgccaaggacucccgcggguacugcagcuccaucaucugcuucgagggcggccucgacaacugggggcagggcacccuggugaccgucagcuccgccagcacgaaggggcccuccguguucccccuggcccccagcuccaagagcaccagcggcggcaccgcggcccucgggugccuggugaaggacuacuucccggagcccgucaccguguccuggaacagcggcgcccugacguccggggugcacaccuuccccgccguccuccagagcuccggccuguacagccuguccagcguggugaccguccccuccagcucccucgggacccagacguacaucugcaacgugaaccacaagccgagcaacaccaagguggacaagcgggucgagcccaaguccugcgacaagacccacacgugcccgcccugcccggcccccgagcugcugggcggccccagcguguuccucuucccgcccaagcccaaggacacccugaugaucucccgcacccccgaggugaccugcgucguggucgacgugagccacgaggaccccgaggugaaguucaacugguacgucgacgggguggaggugcacaacgcgaagaccaagccgcgggaggagcaguacaacuccacguaccgcgucgugagcgugcugaccguccuccaccaggacuggcugaacggcaaggaguacaagugcaagguguccaacaaggcccugcccgcccccaucgagaagaccaucagcaaggccaaggggcagccccgggagccccagguguacacccucccgcccagccgcgacgagcugacgaagaaccaggucucccugaccugccucgugaagggcuucuaccccagcgacaucgccguggagugggaguccaacgggcagcccgagaacaacuacaagaccaccccgcccguccuggacagcgacggcuccuucuuccuguacagcaagcucacgguggacaagucccgguggcagcagggcaacguguucagcugcuccgucaugcacgaggggcugcacaaccacuacacccagaagucccugagccucagccccggcaag

SEQ ID NO: 12978 - RNA, 1428 nt, Artificial Sequence; identical to SEQ ID NO: 12977
  derived and/or modified sequence opt1 from anti-influenza_Chain

SEQ ID NO: 12979 - RNA, 1428 nt, Artificial Sequence; identical to SEQ ID NO: 12977
  derived and/or modified sequence opt1 from anti-influenza_Chain

SEQ ID NO: 12980 - RNA, 1440 nt, Artificial Sequence
  derived and/or modified sequence opt1 from anti-influenza_Chain
augcccagcgugaagaucggcaucaucggggccggcuccgccguguucagccugcgccucguguccgaccugugcaagaccccggggcugagcggcuccaccgugacgcucauggacaucgacgaggagcggcuggacgcgauccugaccaucgccaagaaguacgucgaggaggugggggccgaccucaaguucgagaagaccaugaaccuggacgacgugaucaucgacgccgacuucgucaucaacaccgccauggugggcggccacacguaccuggagaaggugcgccagaucggggagaaguacggcuacuaccgggggaucgacgcgcaggaguucaacauggucagcgacuacuacaccuucuccaacuacaaccagcucaaguacuucguggacaucgcccgcaagaucgagaagcugagccccaaggccugguaccugcaggccgcgaaccccaucuucgagggcaccacccucgugacgcggaccguccccaucaaggccgugggguucugccacggccacuacggcgugauggagaucgucgagaagcuggggcuggaggaggagaagguggacuggcaggucgccggcgugaaccacgggaucuggcucaaccgcuuccgguacaacggcggcaacgccuacccgcugcuggacaaguggaucgaggagaaguccaaggacuggaagcccgagaaccccuucaacgaccagcucagccccgccgcgaucgacauguaccgcuucuacggggugaugccgaucggcgacaccgugcggaacuccagcuggcgcuaccaccgggaccuggagaccaagaagaagugguacggggagcccuggggcggggccgacuccgagaucggcuggaagugguaccaggacacgcugggcaaggucaccgagaucaccaagaagguggccaaguucaucaaggagaaccccagcgugcgccucuccgaccuggggagcguccugggcaaggaccucuccgagaagcaguucgugcuggaggucgagaagauccuggaccccgagcgcaagagcggggagcagcacaucccguucaucgacgcccuccugaacgacaacaaggcccgguucguggugaacauccccaacaagggcaucauccacgggaucgacgacgacgucgugguggagguccccgcgcugguggacaagaacggcauccaccccgagaagaucgagccgccccuccccgaccggguggucaaguacuaccugcgcccccggaucaugcgcauggagauggcccuggaggccuuccucaccggcgacauccggaucaucaaggagcugcuguaccgcgacccgcggacgaaguccgacgagcaggucgagaaggugaucgaggagauccucgcccugcccgagaacgaggagaugcgcaagcacuaccugaagcgc

SEQ ID NO: 12981 - RNA, 1440 nt, Artificial Sequence; identical to SEQ ID NO: 12980
  derived and/or modified sequence opt1 from anti-influenza_Chain

SEQ ID NO: 12982 - RNA, 1443 nt, Artificial Sequence
  derived and/or modified sequence opt1 from anti-influenza_Chain
augaaguuccccaaggacuucaugaucggcuacagcuccagcccguuccaguucgaggccgggauccccggcuccgaggaccccaacagcgacugguggguguggguccacgaccccgagaacaccgccgcggggcugguguccggcgacuucccggagaacgggcccggcuacuggaaccucaaccagaacgaccacgaccuggccgagaagcugggcgugaacaccauccgcgucgggguggaguggagccggaucuuccccaagcccacguucaacgugaaggucccgguggagcgcgacgagaacggcuccaucgugcacgucgacguggacgacaaggccguggagcggcucgacgagcuggccaacaaggaggccgucaaccacuacguggagauguacaaggacuggguggagcgcgggcggaagcugauccucaaccuguaccacuggccccugccccucuggcugcacaaccccaucaugguccgccggaugggcccggaccgcgcgcccagcggguggcugaacgaggaguccgugguggaguucgccaaguacgccgccuacaucgcguggaagaugggcgagcuccccgucauguggagcaccaugaacgagcccaacgugguguacgagcagggcuacauguucgucaagggcggguucccgcccggguaccugucccuggaggccgccgacaaggcccggcgcaacaugauccaggcccacgcgcgggccuacgacaacaucaagcgcuucagcaagaagcccgugggccucaucuacgccuuccagugguucgagcugcuggagggccccgccgagguguucgacaaguucaaguccagcaagcucuacuacuucaccgacaucgucuccaaggggagcuccaucaucaacguggaguaccggcgcgaccuggccaaccggcuggacuggcucggcgucaacuacuacagccgccugguguacaagaucguggacgacaagccgaucauccugcacggguacggcuuccucugcacccccgggggcaucucccccgcggagaaccccugcagcgacuucggcugggaggucuacccggaggggcuguaccugcuccugaaggagcuguacaaccgguacggcguggaccucaucgugacggagaacggggucagcgacucccgcgacgcccugcggcccgccuaccuggugagccacguguacuccgucuggaaggccgccaacgagggcauccccgugaagggguaccuccacuggagccugaccgacaacuacgagugggcgcagggcuuccgccagaaguucggccuggugauggucgacuucaagaccaagaagcgguaccuccgccccuccgcccugguguuccgcgagaucgccacccacaacgggaucccggacgagcugcagcaccucacgcugauccag

SEQ ID NO: 12983 - RNA, 1443 nt, Artificial Sequence; identical to SEQ ID NO: 12982
  derived and/or modified sequence opt1 from anti-influenza_Chain

SEQ ID NO: 12984 - RNA, 1464 nt, Artificial Sequence
  derived and/or modified sequence opt1 from anti-influenza_Chain
cacgcccaggacauccuggagaagacccacaacggcaagcucugcgaccuggacggggugaagccccugauccuccgcgacugcagcgucgccggcuggcugcuggggaacccgaugugcgacgaguucaucaacgugcccgagugguccuacaucguggagaaggcgaaccccgccaacgaccucugcuaccccggcaacuucaacgacuacgaggagcugaagcaccuccucagccggaucaaccacuucgagaagauccagaucaucccgaaguccagcugguccgaccacgaggccagcuccggggucagcuccgccugccccuaccagggcacccccagcuucuuccgcaacgugguguggcugaucaagaagaacaacacguaccccaccaucaagcgguccuacaacaacaccaaccaggaggaccugcucauccuguggggcauccaccacagcaacgacgccgcggagcagaccaagcuguaccagaacccgacgaccuacaucuccgucgggaccagcacccucaaccagcgccuggugcccaagaucgccacgcgguccaaggugaacggccagaacgggcgcauggacuucuucuggaccauccugaagcccaacgacgccaucaacuucgagagcaacggcaacuucaucgcccccgaguacgcguacaagaucgucaagaagggguacaucccggaggcgccccgggacggccaggccuacgugcgcaaggacggcgagugggugcuccuguccaccuuccugcggagcgacaagacccacacgugcccgcccugcccggcccccgagcuccucgggggccccuccgucuuccuguucccgcccaagcccaaggacacccugaugaucagccgcacccccgaggugaccugcguggucguggacgugagccacgaggaccccgaggucaaguucaacugguacguggacgggguggagguccacaacgccaagacgaagccgcgggaggagcaguacaacuccaccuaccgcguggugagcguccugaccgugcugcaccaggacuggcucaacggcaaggaguacaagugcaaggucuccaacaaggcccugcccgcccccaucgagaagaccaucagcaaggccaagggccagccccgggagccccagguguacacgcugccgcccucccgcgaggagaugaccaagaaccaggugagccugaccugccuggucaagggguucuaccccuccgacaucgccguggagugggagagcaacggccagcccgagaacaacuacaagaccacgccgcccgugcuggacuccgacgggagcuucuuccucuacuccaagcugaccgucgacaagagccgguggcagcagggcaacguguucuccugcagcgugaugcacgaggcccugcacaaccacuacacccagaagucccucagccugucccccgggaag

SEQ ID NO: 12985 - RNA, 1464 nt, Artificial Sequence; identical to SEQ ID NO: 12984
  derived and/or modified sequence opt1 from anti-influenza_Chain

SEQ ID NO: 12986 - RNA, 1473 nt, Artificial Sequence
  derived and/or modified sequence opt1 from anti-influenza_Chain
augcugagcuuccccaagggcuucaaguucggguggucccagagcggcuuccaguccgagauggggacccccggcagcgaggaccccaacuccgacuggcacguguggguccacgaccgcgagaacaucgugagccagguggucuccggggaccuccccgagaacggccccggcuacugggggaacuacaagcgguuccacgacgaggccgagaagaucggccugaacgccgugcgcaucaacguggaguggagccggaucuucccgcgcccccugcccaagcccgagaugcagaccgggacggacaaggagaacuccccggucaucagcguggaccucaacgaguccaagcugcgggagauggacaacuacgcgaaccacgaggcccugagccacuaccgccagauccucgaggaccugcggaaccgcggcuuccacaucgugcugaacauguaccacuggacccuccccaucuggcugcacgaccccauccggguccgccgcggggacuucaccggccccaccggcuggcugaacucccggacgguguacgaguucgcccgguucagcgccuacguggccuggaagcucgacgaccuggcguccgaguacgccaccaugaacgagccgaacgucguguggggcgccggguacgccuucccccgcgcgggguucccgcccaacuaccugagcuuccggcucuccgagaucgccaaguggaacaucauccaggcccacgcccgcgccuacgacgcgaucaagagcguguccaagaaguccgucggcaucaucuacgccaacaccagcuacuacccccugcggccccaggacaacgaggccguggagaucgccgagcgccugaaccgguggagcuucuucgacagcaucaucaagggcgagaucaccuccgaggggcagaacgugcgcgaggaccuccggaaccgccuggacuggaucggcgucaacuacuacacgcgcaccguggugaccaaggccgagagcggguaccugacccuccccggcuacggggaccggugcgagcgcaacucccugagccuggcgaaccuccccacguccgacuucggcugggaguucuucccggagggccuguacgacguccugcucaaguacuggaaccgguacgggcugccccuguacgugauggagaacggcaucgccgacgacgccgacuaccagcgccccuacuaccucgugagccacaucuaccagguccaccgggcccugaacgaggggguggacguccgcggcuaccugcacuggucccucgccgacaacuacgaguggagcuccggguucagcaugcgguucggccugcugaagguggacuaccucaccaagcgccuguacuggcggcccuccgcgcugguguaccgcgagaucacccggagcaacggcaucccggaggagcucgagcaccugaaccgcgucccgcccaucaagccccugcggcac

SEQ ID NO: 12987 - RNA, 1473 nt, Artificial Sequence; identical to SEQ ID NO: 12986
  derived and/or modified sequence opt1 from anti-influenza_Chain

SEQ ID NO: 12988 - RNA, 1494 nt, Artificial Sequence
  derived and/or modified sequence opt1 from anti-influenza_Chain
auggccagccagggcaccaagcgcuccuacgagcagauggagaccgacggggagcggcagaacgccacggagauccgcgcgagcgugggcaagaugaucgggggcaucgggcgguucuacauccagaugugcaccgagcugaagcucuccgacuacgagggccgccugauccagaacagccugaccaucgagcggaugguccucuccgccuucgacgagcgccggaacaaguaccuggaggagcaccccagcgccggcaaggacccgaagaagaccgggggccccaucuaccgccgggugaacgggaaguggaugcgcgagcugauccucuacgacaaggaggagauccggcgcaucuggcggcaggccaacaacggcgacgacgccacggcggggcugacccacaugaugaucuggcacuccaaccugaacgacgccaccuaccagcgcacccgggcccucgugcgcacgggcauggacccccggaugugcagccugaugcagggcuccacccugccccgccggagcggggccgcgggcgccgccgucaagggggugggcaccauggugauggagcucguccgcaugaucaagcggggcaucaacgaccgcaacuucuggcgcggggagaacggccggaagacccgcaucgccuacgagcggaugugcaacauccugaaggggaaguuccagacggccgcgcagaaggccaugauggaccaggugcgcgagucccgggacccgggcaacgccgaguucgaggaccugaccuuccucgcccgcagcgcccugauccugcggggguccguggcgcacaagagcugccuccccgccugcgucuacggccccgccguggccuccggcuacgacuucgagcgcgagggguacagccuggugggcaucgaccccuuccggcugcuccagaacucccaggucuacagccugauccgcccgaacgagaaccccgcccacaagucccagcugguguggauggcgugccacagcgccgccuucgaggaccuccgggugcugagcuucaucaaggggaccaaggucgugccccgcggcaagcuguccacccgcggggugcagaucgccagcaacgagaacauggagacgauggaguccagcacccucgagcugcggucccgguacugggccauccgcacccggagcggcggcaacaccaaccagcagcgcgcguccgccgggcagaucagcauccagcccacguucuccguccagcggaaccugccguucgaccgcaccaccgugauggccgccuucaccggcaacacggaggggcgcaccagcgacaugcggaccgagaucauccgcaugauggaguccgcgcggcccgaggacgugagcuuccagggccgcggggucuucgagcucuccgacgagaaggccgccagccccaucgugcccuccuucgacaugagcaacgagggcuccuacuucuucggcgacaacgccgaggaguacgacaac

SEQ ID NO: 12989 - RNA, 1494 nt, Artificial Sequence
  derived and/or modified sequence opt1 from anti-influenza_Chain
auggccagccagggcaccaagcgguccuacgagcagauggagaccgacggggagcggcagaacgccacggagauccgcgcgagcgugggcaagaugaucgacgggaucggccgguucuacauccagaugugcaccgagcugaagcucuccgacuacgaggggcgccugauccagaacagccugaccaucgagcggaugguccucuccgccuucgacgagcgccggaacaaguaccuggaggagcaccccagcgccggcaaggacccgaagaagaccggcgggcccaucuacaagcgcguggacggcaaguggaugcgggagcuggugcucuacgacaaggaggagauccgccggaucuggcgccaggccaacaacggggacgacgccacggcgggccugacccacaugaugaucuggcacuccaaccugaacgacaccaccuaccagcggacgcgcgcccucguccggaccgggauggacccccgcaugugcagccugaugcagggcuccacccugccccggcgcagcggcgccgccggggcggccgugaagggcguggggaccauggucauggagcucauccggaugaucaagcgcggcaucaacgaccggaacuucuggcgcggcgagaacgggcgcaagacgcgguccgccuacgagcgcaugugcaacauccugaagggcaaguuccagaccgccgcccagcgggcgaugauggaccaggugcgcgagagccggaacccggggaacgccgagaucgaggaccugaucuuccucgcccgcuccgcccugauccugcggggcagcguggcccacaaguccugccuccccgcgugcgucuacgggcccgccaucgccagcggcuacaacuucgagaaggagggcuacucccugguggggaucgaccccuucaagcugcuccagaacagccagguguacucccugauccgcccgaacgagaaccccgcccacaagagccagcuggucuggauggccugcaacagcgcggccuucgaggaccuccgggugcuguccuucauccgcggcaccaaggugagcccccgggggaagcuguccacccgcggcguccagaucgccagcaacgagaacauggacacgauggaguccagcacccucgagcugcggucccgcuacugggccauccggacccgcagcgggggcaacaccaaccagcagcgggccuccgcgggccagaucagcgugcagcccgccuucuccgugcagcgcaaccugccguucgacaagcccacgaucauggccgccuucaccgggaacaccgagggccggaccagcgacaugcgcgcggagaucauccgcaugauggagggggccaagcccgaggagauguccuuccagggccgcggggucuucgagcucagcgacgagaaggccacgaaccccaucgugccguccuucgacaugagcaacgagggcuccuacuucuucggcgacaacgccgaggaguacgacaac

SEQ ID NO: 12990 - RNA, 1494 nt, Artificial Sequence
  derived and/or modified sequence opt1 from anti-influenza_Chain
auggccagccagggcaccaagcgcuccuacgagcagauggagaccgggggcgagcggcagaacgccacggagauccgcgcgagcguggggcggauggucggcgggaucggccgcuucuacgugcagaugugcaccgagcugaagcucuccgaccaggagggccggcugauccagaacagcaucaccaucgagcgcauggugcuguccgccuucgacgagcggcgcaaccgguaccucgaggagcaccccagcgccgggaaggacccgaagaagaccggcgggcccaucuaccgccggcgcgacggcaaguggguccgggagcugauccuguacgacaaggaggagauccgccggaucuggcgccaggccaacaacggggaggacgccacggcgggccucacccacaugaugaucuggcacuccaaccugaacgacgccaccuaccagcggacccgcgcccuggugcggacgggcauggacccccgcaugugcagccucaugcagggguccacccugccccggcgcagcggcgccgcgggggccgccaucaagggcgugggcaccauggucauggagcugauccgcaugaucaagcgggggaucaacgaccgcaacuucuggcggggcgacaacgggcgccggacccgcaucgccuacgagcggaugugcaacauccucaagggcaaguuccagacggccgcgcagcgcgccaugauggaccaggugcgggagucccgcaacccggggaacgccgagaucgaggaccugaucuuccuggcccggagcgcccucauccugcgcggcuccguggcgcacaagagcugccugcccgccugcgucuacggccucgccguggccuccggguacgacuucgagcgggagggcuacagccugguggggaucgaccccuuccgccugcuccagaacucccaggucuucagccugauccggcccaacgagaacccggcccacaagucccagcugguguggauggcgugccacagcgccgccuucgaggaccuccgcgugagcuccuucauccggggcacccgcgucaucccccgggggcagcugagcacccgcggcgugcagaucgccuccaacgagaacguggaggccauggacagcuccacccuggagcuccgcagccgguacugggcgauccgcacgcgguccggcgggaacaccaaccagcagcgcgccagcgccggccagaucuccguccagcccaccuucagcgugcagcggaaccugcccuucgagcgcccgaccaucauggccgcguucaaggggaacacggagggccggaccuccgacaugcgcaccgagaucauccggaugauggagagcgcccgccccgaggacguguccuuccaggggcggggcgucuucgagcugagcgacgagaaggccaccaaccccaucgugcccuccuucgacaugagcaacgagggcuccuacuucuucggggacaacgccgaggaguacgacaac

SEQ ID NO: 12991 - RNA, 1494 nt, Artificial Sequence; identical to SEQ ID NO: 12988
  derived and/or modified sequence opt1 from anti-influenza_Chain

SEQ ID NO: 12992 - RNA, 1494 nt, Artificial Sequence; identical to SEQ ID NO: 12989
  derived and/or modified sequence opt1 from anti-influenza_Chain

SEQ ID NO: 12993 - RNA, 1494 nt, Artificial Sequence; identical to SEQ ID NO: 12990
  derived and/or modified sequence opt1 from anti-influenza_Chain

SEQ ID NO: 12994 - RNA, 1530 nt, Artificial Sequence
  derived and/or modified sequence opt1 from anti-influenza_Chain
auguuccccgagaaguuccuguggggcguggcccagagcggguuccaguucgagaugggcgacaagcuccgccggaacaucgacaccaacaccgacugguggcacuggguccgcgacaagacgaacaucgagaaggggcugguguccggcgaccugccggaggaggggaucaacaacuacgagcucuacgagaaggaccacgagaucgcccggaagcugggccugaacgcguaccgcaucggcaucgaguggagccggaucuuccccuggcccaccaccuucaucgacguggacuacuccuacaacgagagcuacaaccucaucgaggacgucaagaucaccaaggacacgcuggaggagcuggacgagaucgccaacaagcgcgagguggccuacuaccgguccgugaucaacagccuccgcuccaagggguucaaggucaucgugaaccugaaccacuucacccugcccuacuggcuccacgacccgaucgaggcccgggagcgcgcccugaccaacaagcggaacggcugggugaacccccgcaccgucaucgaguucgcgaaguacgccgccuacaucgccuacaaguucggggacaucguggacauguggagcacguucaacgagcccaugguggucguggagcugggcuaccucgcgcccuacuccggguucccgcccggcgugcugaaccccgaggccgccaagcuggccauccuccacaugaucaacgcccacgcgcuggccuaccggcagaucaagaaguucgacaccgagaaggccgacaaggacagcaaggagcccgccgaggucggcaucaucuacaacaacaucgggguggccuacccgaaggaccccaacgacuccaaggacgugaaggcggccgagaacgacaacuucuuccacagcggccuguucuucgaggccauccacaaggggaagcucaacaucgaguucgacggcgagaccuucaucgacgcccccuaccugaagggcaacgacuggaucggggucaacuacuacacccgcgagguggugacguaccaggagcccauguucccguccaucccccugaucaccuucaagggcguccagggguacggcuacgccugccggcccgggacccucagcaaggacgaccgccccguguccgacaucggcugggagcuguacccggagggcauguacgacagcaucguggaggcgcacaaguacgggguccccguguacgucaccgagaacggcaucgccgacuccaaggacauccugcggcccuacuacaucgccagccacaucaagaugacggagaaggccuucgaggacggguacgaggugaagggcuacuuccacugggcccucaccgacaacuucgagugggcgcugggguuccgcaugcgguucggccuguacgaggugaaccucaucaccaaggagcgcaucccccgggagaaguccgucagcaucuuccgcgagaucguggccaacaacggcgugaccaagaagaucgaggaggagcugcugcgcggg

SEQ ID NO: 12995 - RNA, 1530 nt, Artificial Sequence; identical to SEQ ID NO: 12994
  derived and/or modified sequence opt1 from anti-influenza_Chain

SEQ ID NO: 12996 - RNA, 1536 nt, Artificial Sequence
  derived and/or modified sequence opt1 from anti-influenza_Chain
augaagcgcaaggugaagaagauggccgccauggcgaccagcaucaucauggccaucaugaucauccugcacuccauccccguccucgccggccggaucaucuacgacaacgagaccgggacgcacggcggguacgacuacgagcuguggaaggacuacggcaacaccaucauggagcugaacgacgggggcaccuucagcugccagugguccaacaucggcaacgcccucuuccgcaaggggcggaaguucaacagcgacaagaccuaccaggagcugggcgacaucgugguggaguacgggugcgacuacaacccgaacggcaacuccuaccugugcgucuacggguggacgcgcaacccccucguggaguacuacaucguggagagcuggggcuccuggcggccgcccggcgccacccccaaggggaccaucacccaguggauggcgggcacguacgagaucuacgagaccacccgcgucaaccagcccagcaucgacgggaccgccacguuccagcaguacugguccgugcggaccagcaagcgcaccuccggcaccaucagcgugacggagcacuucaagcagugggagcggaugggcaugcgcauggggaagauguacgaggucgcccugaccguggagggcuaccaguccagcggguacgccaacguguacaagaacgagauccggaucggcgcgaaccccacccccgccccgucccagagccccauccgccgggacgccuucuccaucaucgaggccgaggaguacaacagcaccaacuccagcacgcugcaggucaucgggacccccaacaacggccgcggcaucggguacaucgagaacggcaacaccgugaccuacagcaacaucgacuucggguccggcgccacgggguucagcgcgaccguggccaccgaggucaacaccuccauccagauccggagcgacucccccacgggcacccuccugggcacccuguacgugagcuccaccgggagcuggaacacguaccagaccguguccaccaacaucagcaagaucaccggcguccacgacaucgugcucguguucuccgggccggucaacguggacaacuucaucuucagccgcuccagccccgugcccgcccccggcgacaacacgcgggacgccuacuccaucauccaggccgaggacuacgacagcuccuacgggccgaaccugcagaucuucagccugcccggcggcggguccgcgaucggcuacaucgagaacggguacagcaccaccuacaagaacaucgacuucggcgacggcgccaccagcgucaccgcccgcguggccacgcagaacgccaccaccauccagguccggcucgggucccccagcggcacccugcuggggacgaucuacgugggcuccaccgggagcuucgacaccuaccgcgacguguccgcgaccaucagcaacacggccggcgucaaggacaucgugcucguguucuccggccccgucaacguggacugguucguguucagcaaguccgggacc

SEQ ID NO: 12997 - RNA, 1536 nt, Artificial Sequence; identical to SEQ ID NO: 12996
  derived and/or modified sequence opt1 from anti-influenza_Chain

SEQ ID NO: 12998 - RNA, 1539 nt, Artificial Sequence
  derived and/or modified sequence opt1 from anti-influenza_Chain
aucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccucucccggaucaaccacuucgagaagauccagaucauccccaagagcuccuggagcgaccacgaggccuccagcggcgucuccagcgccugccccuaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaagggcuacaucccggaggcgccccgggacggccaggccuacgugcgcaaggacggggagugggugcuccugagcaccuuccugcgguccgacaagacccacacgugcccgcccugcccggcccccgagcuccugggcgggcccagcgucuuccuguucccgccgaagcccaaggacacccucaugaucagccgcacccccgaggugaccugcguggucguggacgugucccacgaggaccccgaggucaaguucaacugguacguggacggcguggagguccacaacgccaagacgaagccgcgggaggagcaguacaacagcaccuaccgcguggucuccgugcugaccgugcugcaccaggacuggcucaacggcaaggaguacaagugcaaggucagcaacaaggcccugcccgcccccaucgagaagaccaucuccaaggccaaggggcagccccgggagccccagguguacacgcugccgcccagccgcgaggagaugaccaagaaccaggugucccugaccugccuggucaagggcuucuaccccagcgacaucgccguggagugggaguccaacgggcagcccgagaacaacuacaagaccacgccgcccgugcuggacagcgacggcuccuucuuccucuacagcaagcugaccgucgacaagucccgguggcagcaggggaacguguucagcugcuccgugaugcacgaggcgcugcacaaccacuacacccagaagucccucagccugagccccggcaag

SEQ ID NO: 12999 - RNA, 1539 nt, Artificial Sequence; identical to SEQ ID NO: 12998
  derived and/or modified sequence opt1 from anti-influenza_Chain

SEQ ID NO: 13000 - RNA, 1593 nt, Artificial Sequence
  derived and/or modified sequence opt1 from anti-influenza_Chain
acccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugacggccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcaccucccgguacagcaagaaguucaagcccgagaucgcgauccgcccgaaggugcgggaccaggagggccgcaugaacuacuacuggacccugguggagcccggggacaagaucacguucgaggccaccggcaaccucgucgugccccgguacgccuucgccauggagcgcgacgccggguccggcaucaucaucagcgacacccccgugcacgacugcaacaccacgugccagaccccgaagggcgcgaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacgagaucacgaacaaggucaacuccgugaucgagaagaugaacacccaguucaccgccgugggcaaggaguucaaccaccuggagaagcgcaucgagaaccugaacaagaagaucgacgacggcuuccucgacaucuggaccuacaacgccgagcugcugguccuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggcc

SEQ ID NO: 13001 - RNA, 1593 nt, Artificial Sequence
  derived and/or modified sequence opt1 from anti-influenza_Chain
acccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcugcaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugacggccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcaccucccgguacagcaagaaguucaagcccgagaucgcgauccgcccgaaggugcgggaccaggagggccgcaugaacuacuacuggacccugguggagcccggggacaagaucacguucgaggccaccggcaaccucgucgugccccgguacgccuucgccauggagcgcgacgccggguccggcaucaucaucagcgacacccccgugcacgacugcaacaccacgugccagaccccgaagggcgcgaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacgagaucacgaacaaggucaacuccgugaucgagaagaugaacacccaguucaccgccgugggcaaggaguucaaccaccuggagaagcgcaucgagaaccugaacaagaagaucgacgacggcuuccucgacaucuggaccuacaacgccgagcugcugguccuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggcc

SEQ ID NO: 13002 - RNA, 1593 nt, Artificial Sequence
  derived and/or modified sequence opt1 from anti-influenza_Chain
acccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaacaccagcuccuggcccaaccacgacagcaacaagggcgugacggccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcaccucccgguacagcaagaaguucaagcccgagaucgcgauccgcccgaaggugcgggaccaggagggccgcaugaacuacuacuggacccugguggagcccggggacaagaucacguucgaggccaccggcaaccucgucgugccccgguacgccuucgccauggagcgcgacgccggguccggcaucaucaucagcgacacccccgugcacgacugcaacaccacgugccagaccccgaagggcgcgaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacgagaucacgaacaaggucaacuccgugaucgagaagaugaacacccaguucaccgccgugggcaaggaguucaaccaccuggagaagcgcaucgagaaccugaacaagaagaucgacgacggcuuccucgacaucuggaccuacaacgccgagcugcugguccuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggcc

SEQ ID NO: 13003 - RNA, 1593 nt, Artificial Sequence
  derived and/or modified sequence opt1 from anti-influenza_Chain
acccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugacggccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcaccucccgguacagcaagaaguucggccccgagaucgcgauccgcccgaaggugcgggaccaggaggggcgcaugaacuacuacuggacccugguggagcccggcgacaagaucacguucgaggccaccgggaaccucgucgugccccgguacgccuucgccauggagcgcgacgccggcuccggcaucaucaucagcgacacccccgugcacgacugcaacaccacgugccagaccccgaagggggcgaucaacaccucccugcccuuccagaacauccaccccaucaccaucggcaagugccccaaguacgucaagagcacgaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagagcacccagaacgccaucgacgagaucacgaacaaggucaacuccgugaucgagaagaugaacacccaguucaccgccgugggcaaggaguucaaccaccuggagaagcgcaucgagaaccugaacaagaagaucgacgacggguuccucgacaucuggaccuacaacgccgagcugcugguccuccuggagaacgagcggacgcuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgcc

SEQ ID NO: 13004 - RNA, 1593 nt, Artificial Sequence; identical to SEQ ID NO: 13000
  derived and/or modified sequence opt1 from anti-influenza_Chain

SEQ ID NO: 13005 - RNA, 1593 nt, Artificial Sequence; identical to SEQ ID NO: 13001
  derived and/or modified sequence opt1 from anti-influenza_Chain

SEQ ID NO: 13006 - RNA, 1593 nt, Artificial Sequence; identical to SEQ ID NO: 13002
  derived and/or modified sequence opt1 from anti-influenza_Chain

SEQ ID NO: 13007 - RNA, 1593 nt, Artificial Sequence; identical to SEQ ID NO: 13003
  derived and/or modified sequence opt1 from anti-influenza_Chain

SEQ ID NO: 13008 - RNA, 1605 nt, Artificial Sequence
  derived and/or modified sequence opt1 from anti-influenza_Chain
gccaacgccgacacccugugcaucggcuaccacgcgaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccgaccacgacagcaacaagggcgugacggccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgcggacgccuacguguucgucggcaccucccgguacagcaagaaguucaagcccgagaucgccauccgcccgaaggugcgggaccaggagggccgcaugaacuacuacuggacccugguggagcccggggacaagaucacguucgaggccaccggcaaccucgucgugccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccgugaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcagccuggugcucgucgugucccugggggcg

SEQ ID NO: 13009 - RNA, 1605 nt, Artificial Sequence
  derived and/or modified sequence opt1 from anti-influenza_Chain
gccaacgccgacacccugugcaucggcuaccacgcgaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugacggccgccugcccgcgggccggcgccaagggguucuacaagaaccugaucuggcucgugaagaagggcaacuccuaccccaagcugaacaagagcuacaucaacgacaaggggaaggagguccuggugcucuggggcauccaccaccccuccaccaccgccgaccagcagagccuguaccagaacgcggacaccuacguguucgucggcacgagccgcuacuccaagaaguucaagcccgagaucgagauccggccgaaggugcgcgaccaggaggggcggaugaacuacuacuggacccugguggagcccggcgacaagaucaccuucgaggccaccgggaaccucgucgugccccgcuacgccuucgccauggagcggaacgccggcagcggcaucaucaucuccgacacgcccgugcacgacugcaacacgaccugccagaccccgaagggggcgaucaacaccagccugcccuuccagaacauccaccccaucaccaucggcaagugccccaaguacgucaaguccaccaagcugcgccucgccaccgggcugcggaacgugccgagcauccagucccgcggccuguucggggccaucgccggcuucaucgagggcggguggacgggcaugguggacgggugguacggcuaccaccaccagaacgagcaggggagcggcuacgccgcggaccucaaguccacccagaacgccaucgacaagaucaccaacaaggucaacagcgugaucgagaagaugaacacccaguucacggccguggacaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgucaagcucgagagcacccggaucuaccagauccuggccaucuacuccaccguggccagcucccuggugcucgucgugagccugggggcc

SEQ ID NO: 13010 - RNA, 1605 nt, Artificial Sequence; identical to SEQ ID NO: 13008
  derived and/or modified sequence opt1 from anti-influenza_Chain

SEQ ID NO: 13011 - RNA, 1605 nt, Artificial Sequence; identical to SEQ ID NO: 13009
  derived and/or modified sequence opt1 from anti-influenza_Chain

SEQ ID NO: 13012 - RNA, 1644 nt, Artificial Sequence
  derived and/or modified sequence opt1 from anti-influenza_Chain
cagaagcugcccggcaacgacaacagcaccgccacccucugccuggggcaccacgccgugccgaacggcacgaucgucaagaccaucaccaacgaccagaucgaggugaccaacgcgacggagcuggugcaguccagcuccaccggggagaucugcgacagcccccaccagauccucgacggcgagaacugcacccugaucgacgcccugcucggggacccccagugcgacggcuuccagaacaagaagugggaccuguucgucgagcgcuccaaggccuacagcaacugcuaccccuacgacgugccggacuacgccucccugcggagccucguggccuccagcggcacccuggaguucaacaacgaguccuucaacuggacgggggucacccagaacggcaccagcuccgcgugcauccgccggagcaacaacuccuucuucagccgccugaacuggcucacccaccugaaguucaaguaccccgcccugaacgugacgaugcccaacaacgagaaguucgacaagcucuacaucuggggcgugcaccaccccgggaccgacaacgaccagaucuucccguacgcccaggccuccgggcggaucaccgucagcaccaagcgcucccagcagacggugauccccaacaucggcagccggccccgcgugcggaacauccccagccgcaucuccaucuacuggaccaucgucaagccgggcgacauccugcugaucaacagcaccgggaaccucaucgcgccccggggcuacuucaagauccgcuccggcaagagcuccaucaugcggagcgacgcccccaucgggaagugcaacuccgagugcaucacccccaacggcagcaucccgaacgacaagcccuuccagaacgugaaccgcaucacguacggggccugcccccgguacgugaagcagaacacccugaagcuggccaccggcaugcgcaacguccccgagaagcagacccgggggaucuucggcgccaucgcgggguucaucgagaacggcugggagggcaugguggacgggugguacggcuuccgccaccagaacuccgaggggaucggccaggccgccgaccucaagagcacgcaggccgccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgcggagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcucaaguccggcuacaaggacuggauccuguggaucagcuucgcgaucuccugcuuccugcucugcguggcccugcugggcuucaucaugugggccugccagaaggggaacauccgcugcaacauc

SEQ ID NO: 13013 - RNA, 1644 nt, Artificial Sequence; identical to SEQ ID NO: 13012
  derived and/or modified sequence opt1 from anti-influenza_Chain

SEQ ID NO: 13014 - RNA, 1647 nt, Artificial Sequence
  derived and/or modified sequence opt1 from anti-influenza_Chain
augcugaccuuccaccgcaucauccggaagggcuggauguuccuccuggccuuccugcucaccgcccugcuguucugccccacggggcagccggcgaaggccgccgcccccuucaacggcaccaugaugcaguacuucgagugguaccuccccgacgacgggacccuguggaccaagguggccaacgaggcgaacaaccugagcucccucggcaucacggcccuguggcugcccccggccuacaaggggaccagccgcuccgacgucggcuacggcguguacgaccucuacgaccugggggaguucaaccagaagggcgccgugcggaccaaguacgggaccaaggcgcaguaccugcaggccauccaggccgcccacgccgcgggcaugcaggucuacgccgacgugguguucgaccacaagggcggggccgacggcacggagugggucgacgccguggaggugaaccccagcgaccgcaaccaggagaucuccgggaccuaccagauccaggccuggaccaaguucgacuuccccggccgggggaacaccuacagcuccuucaaguggcgcugguaccacuucgacggcgucgacugggacgagagccggaagcucucccgcaucuacaaguuccggggcaucgggaaggcgugggacugggagguggacacggagaacggcaacuacgacuaccugauguacgccgaccuggacauggaccaccccgagguggucaccgagcucaagagcugggggaagugguacgugaacaccaccaacaucgacggcuuccgccuggacgccgugaagcacaucaaguucuccuucuucccggacuggcugagcgacguccggucccagacggggaagccccucuucaccgugggcgaguacuggagcuacgacaucaacaagcugcacaacuacaucaugaagaccaacggcaccaugucccuguucgacgcgccccuccacaacaaguucuacacggccagcaaguccgggggcaccuucgacaugcgcacccugaugaccaacacgcugaugaaggaccagcccacccucgccgugaccuucgucgacaaccacgacaccgagccggggcaggcccugcagagcuggguggaccccugguucaagccccuggccuacgccuucauccucacgcggcaggagggcuaccccugcguguucuacggggacuacuacggcaucccgcaguacaacauccccucccucaagagcaagaucgacccccugcugaucgcccgccgggacuacgcguacggcacccagcacgacuaccuggaccacagcgacaucaucggguggacccgcgagggcgucaccgagaagcccggguccggccuggccgcccucaucacggacgggccgggcggcagcaaguggauguacguggggaagcagcacgccggcaagguguucuacgaccugaccgggaaccgguccgacaccgucaccaucaacagcgacggcuggggcgaguucaaggugaacgggggcuccgucagcgugugggugccccgcaagacgaccgucuccaccaucgcguggagcaucaccacccggcccuggacggacgaguucgugcgcuggaccgagccccggcugguggccuggccg

SEQ ID NO: 13015 - RNA, 1647 nt, Artificial Sequence
  derived and/or modified sequence opt1 from anti-influenza_Chain
aucugcaucggcuaccacgccaacaacagcaccgagcaggucgacaccaucauggagaagaacgucacggugacccacgcccaggacauccuggagaagacccacaacgggaagcucugcgaccuggacggcgugaagccccugauccuccgcgacugcuccgucgcgggguggcugcugggcaaccccaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugccccuaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaagggcgacagcgccaucgugaaguccgagguggaguacggcaacugcaacaccaagugccagaccccgaucggggccaucaacagcagcaugcccuuccacaacauccacccccucacgaucggcgagugccccaaguacgucaaguccaacaagcuggugcuggccaccgggcuccggaacagcccgcugcgcuccgacaagacccacacgugcccgcccugccccgcgccggagcugcucggcggccccagcguguuccuguucccgcccaagcccaaggacacccugaugaucucccggacccccgaggugaccugcgugguggucgacgugagccacgaggaccccgaggugaaguucaacugguacgucgacgggguggagguccacaacgccaagaccaagccccgcgaggagcaguacaacuccacguaccggguggugagcguccucaccgugcugcaccaggacuggcugaacggcaaggaguacaagugcaagguguccaacaaggcccucccggcccccaucgagaagaccaucagcaaggccaaggggcagccccgcgagccgcaggucuacacccugccgcccucccgggaggagaugacgaagaaccaggugagccugaccugccucgugaagggcuucuaccccuccgacaucgcggucgagugggagagcaacgggcagcccgagaacaacuacaagaccaccccgcccgugcuggacuccgacggcagcuucuuccuguacuccaagcucacgguggacaagagccgcuggcagcagggcaacgucuucuccugcagcgugaugcacgaggcccugcacaaccacuacacccagaagucccugagccucagccccgggaag

SEQ ID NO: 13016 - RNA, 1647 nt, Artificial Sequence; identical to SEQ ID NO: 13015
  derived and/or modified sequence opt1 from anti-influenza_Chain

SEQ ID NO: 13017 - RNA, 1647 nt, Artificial Sequence; identical to SEQ ID NO: 13014
  derived and/or modified sequence opt1 from anti-influenza_Chain

SEQ ID NO: 13018 - RNA, 1650 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccaccaacgaccucugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcugaucaagaagaacagcacguaccccaccaucaagaaguccuacaacaacaccaaccaggaggaccuccugguccugugggggauccaccacccgaacgacgccgcggagcagacccggcucuaccagaaccccacgaccuacaucagcaucggcaccuccacccugaaccagcgccuggugcccaagaucgccacgcggagcaaggugaacgggcaguccggccgcauggaguucuucugggccauccucaagcccaacgacgccaucaacuucgagagcaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccugaccaucggcgagugcccgaaguacgugaaguccaaccggcucgugcuggccacggggcugcgcaacagcccccagcgggagagccgccggaagaagcgcggccucuucggcgcgaucgccggguucaucgagggcggguggcagggcauggucgacgggugguacggcuaccaccacuccaacgagcagggcagcggguacgccgccgacaaggaguccacccagaaggccaucggcgugaccaacaaggugaacagcaucaucgacaagaugaacacccaguucgaggcggucgggcgggaguucaacaaccuggagcgccggaucgagaaccugaacaagaagauggaggacggcuuccucgacguguggacguacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcauccggaacggcaccuacaacccccaguacuccgaggaggcccgccucaagcgggaggagaucagcggggugaagcuggaguccaucggcaccuaccagauccugagcaucuacuccacggucgccagcucccucgcgcuggccaucaugaucgccgggcugagccucuggaugugcagcaacggcucccugcagugccgcaucugcauc

SEQ ID NO: 13019 - RNA, 1650 nt, Artificial Sequence; identical to SEQ ID NO: 13018
  derived and/or modified sequence opt1 from anti-influenza_Chain

SEQ ID NO: 13020 - RNA, 1656 nt, Artificial Sequence
  derived and/or modified sequence opt1 from anti-influenza_Chain
augaacauccagauccuggccuucaucgccugcgugcucaccggcgcgaagggggacaagaucugccugggccaccacgccgucgccaacgggaccaaggugaacacgcugaccgagaagggcaucgagguggucaacgccaccgagaccguggagacggccgacgugaagaagaucugcacccaggggaagcgcgcgaccgaccucggccggugcggccugcuggggacccucaucgggcccccgcagugcgaccaguuccuggaguucagcuccgaccugaucaucgagcgccgggagggcacggacgucugcuaccccggccgcuucaccaacgaggagagccuccggcagauccugcgccgguccgggggcaucggcaaggagagcaugggguucaccuacuccggcauccgcaccaacggggccgccagcgccugcacgcgguccggcagcuccuucuacgcggagaugaaguggcugcucagcaacuccgacaacagcgccuucccccagaugaccaaggccuaccgcaacccccggaacaagccggcccugaucaucuggggcgugcaccacuccgagagcgccuccgagcagaccaagcuguacgggagcggcaacaagcucaucaccgugcgcuccagcaaguaccagcaguccuucacgcccagccccgggacccggcgcaucgacuuccacuggcugcugcucgaccccaacgacaccgucaccuucacguucaacggcgcguucaucgccccggaccgggccagcuucuuccgcggggagucccugggcgugcagagcgacgcgccccuggacuccagcugccggggcgacugcuuccacuccgggggcaccaucgugagcucccuccccuuccagaacaucaacagccgcaccgucgggcggugcccccgcuacgugaagcagaagucccugcugcucgccaccggcaugcggaacgugccggagaagcccaagccccgcgggcuguucggcgccaucgccggcuucaucgagaacgggugggagggccugaucaacgggugguacggcuuccgccaccagaacgcccagggggagggcacggccgccgacuacaagagcacccaguccgcgaucgaccagaucaccggcaagcucaaccggcugaucgggaagaccaaccagcaguucgagcugaucgacaacgaguucaacgagaucgagcagcagaucggcaacgucaucaacuggacgcgcgacgccaugaccgagaucuggagcuacaacgccgagcuccugguggccauggagaaccagcacaccaucgaccuggccgacuccgagaugagcaagcucuacgagcgggugaagaagcagcugcgcgagaacgcggaggaggacgggaccggcugcuucgagaucuuccacaagugcgacgaccagugcauggaguccauccggaacaacacguacgaccacacccaguaccgcaccgagagccugcagaaccggauccagaucgaccccgucaagcucuccagcggcuacaaggacaucauccugugguucuccuucggggccagcugcuucauccugcucgccaucgccaugggccugguguucaucugcaucaagaacgggaacaugcagugcaccaucugcauc

SEQ ID NO: 13021 - RNA, 1656 nt, Artificial Sequence
  derived and/or modified sequence opt1 from anti-influenza_Chain
augaacacccagauccuggccuucaucgccugcgugcucaccggcgucaagggggacaagaucugccugggccaccacgcgguggccaacgggacgaaggugaacacccugaccgagaagggcaucgaggucgugaacgccaccgagacgguggagaccgccgacgucaagaagaucugcacccaggggaagcgcgccaccgaccucggccggugcggccugcuggggacgcucaucgggcccccgcagugcgaccaguuccuggaguucagcuccgaccugaucaucgagcgccgggagggcaccgacgugugcuaccccggccgcuucaccaacgaggagagccuccggcagauccugcgccgguccgggggcaucggcaaggagagcaugggguucaccuacuccggcauccgcacgaacggggcgaccagcgccugcacccgguccggcagcuccuucuacgccgagaugaaguggcugcucagcaacuccgacaacagcgccuucccccagaugaccaaggcguaccgcaacccccggaacaagccggcccugaucaucuggggcgugcaccacuccgagagcgucuccgagcagacgaagcuguacgggagcggcaacaagcucaucaccgugcgcuccagcaaguaccagcaguccuucacccccagccccggggcccggcgcaucgacuuccacuggcugcugcucgaccccaacgacaccgugacguucaccuucaacggcgccuucaucgccccggaccgggcgagcuucuuccgcggggagucccugggcguccagagcgacgugccccuggacuccagcugccggggcgacugcuuccacuccgggggcaccaucgugagcucccuccccuuccagaacaucaacagccgcaccgucgggaagugcccccgguacgugaagcagaagucccugcugcucgccacgggcaugcgcaacgugccggagaagcccaagccccgggggcuguucggcgccaucgccggcuucaucgagaacgggugggagggccugaucaacgggugguacggcuuccgccaccagaacgcccagggggagggcaccgcggccgacuacaagagcacccaguccgccaucgaccagaucaccggcaagcucaaccgccugaucgggaagacgaaccagcaguucgagcugaucgacaacgaguucaacgagaucgagcagcagaucggcaacgucaucaacuggacccgggacgccaugaccgagaucuggagcuacaacgccgagcuccugguggcgauggagaaccagcacaccaucgaccuggccgacuccgagaugagcaagcucuacgagcgcgugaagaagcagcugcgggagaacgccgaggaggacgggacgggcugcuucgagaucuuccacaagugcgacgaccagugcauggaguccauccgcaacaacaccuacgaccacacccaguaccggaccgagagccugcagaaccgcauccagaucgaccccgucaagcucuccagcggcuacaaggacaucauccugugguucuccuucggggccagcugcuuccugcuccuggccaucgcgaugggccugguguucaucugcaucaagaacgggaacaugcagugcacgaucugcauc

SEQ ID NO: 13022 - RNA, 1656 nt, Artificial Sequence
  derived and/or modified sequence opt1 from anti-influenza_Chain
augaacauccagauccuggccuucaucgccugcgugcucaccggcgcgaagggggacaagaucugccugggccaccacgccgucgccaacgggaccaaggugaacacgcugaccgagaagggcaucgagguggucaacgccaccgagaccguggagacggccaacaucaagaagaucugcacccaggggaagcgccccaccgaccucggccagugcggccugcuggggacccucaucggcccgccccagugcgaccaguuccuggaguucagcuccgaccugaucaucgagcggcgcgaggggacggacgugugcuaccccggcaaguucaccaacgaggagagccuccggcagauccugcgccgguccgggggcaucggcaaggagagcaugggguucaccuacuccggcauccgcaccaacggggcgacgagcgccugcacccgguccggcagcuccuucuacgccgagaugaaguggcugcucagcaacuccgacaacgccgcguucccccagaugaccaagagcuaccgcaacccgcggaacaagcccgcccugaucaucuggggcguccaccacuccgagagcguguccgagcagaccaagcuguacgggagcggcaacaagcucaucaaggugcgcuccagcaaguaccagcaguccuucacgcccaaccccggggcccggcgcaucgacuuccacuggcugcugcucgacccgaacgacaccgucaccuucaccuucaacggcgccuucaucgcccccgaccgggcgagcuucuuccgcggggagagcaucggcgugcaguccgacgcgccccuggacagcuccugcggcgggaacugcuuccacaacggcgggacgaucgugagcucccugcccuuccagaacaucaacccgcggaccgucggcaagugcccccgcuacgugaagcagaagucccuccugcuggccaccgggaugcggaacgugcccgagaagcccaagaagcgcggccucuucggcgccaucgccggguucaucgagaacggcugggaggggcugaucaacggcugguacggguuccggcaccagaacgcccagggcgagggcaccgccgccgacuacaagagcacgcagagcgccaucgaccagaucaccgggaagcugaaccgccucaucggcaagaccaaccagcaguucgagcugaucaacaacgaguucaacgaggucgagcagcagaucgggaacgugaucaacuggacccaggacgccaugacggaggugugguccuacaacgcggagcugcucgucgccauggagaaccagcacaccaucgaccugaccgacagcgagauguccaagcuguacgagcgggugcgcaagcagcuccgcgagaacgccgaggaggacggcaccggcugcuucgagaucuuccacaagugcgacgaccacugcauggagagcauccggaacaacacguacgaccacacccaguaccgcaccgagucccugcagaaccggauccagaucgacccggugaagcugagcgggggcuacaaggacaucauccucugguucuccuucggggccagcugcuuccugcugcucgccaucgcgaugggccuggucuucaucugcaucaagaacgggaacaugcagugcaccaucugcauc

SEQ ID NO: 13023 - RNA, 1656 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccagaacauccuggagaagacccacaacgggaagcucugcgaccuggacggcgugaagccccugauccuccgcgacugcuccgucgcgggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgccuaccccaccaucaagcgcuccuacaacaacacgaaccaggaggaccuccugguccugugggggauccaccaccccaacgacgcggccgagcagacccggcucuaccagaacccgaccaccuacaucagcgugggcacguccacccugaaccagcgccuggugcccaagaucgccacccggagcaaggucaacgggcaguccggccgcauggaguucuucuggaccauccucaagcccaacgacgccaucaacuucgagagcaacgggaacuucaucgcgcccgagaacgccuacaagaucgugaagaagggcgacuccacgaucaugaaguccgagcuggaguacggcaacugcaacaccaagugccagaccccgaucggggccaucaacagcagcaugcccuuccacaacauccacccccugaccaucggcgagugccccaaguacgucaagagcaacaagcucgugcuggccacggggcugcggaacuccccgcagggcgagcgccggcgcaagaagcggggccucuucggggccaucgcgggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacccaguucgaggccgugggccgcgaguucaacaaccuggagcggcgcaucgagaaccugaacaagaagauggaggacggguuccucgacguguggacguacaacgcggagcugcugguccucauggagaacgagcggacccuggacuuccacgacagcaacgugaagaaccuguacgacaagauccgccuccagcugcgggacaacgccaaggagcugggcaacggcugcuucgaguucuaccaccgcugcgacaacgagugcauggaguccgugcggaacgggaccuacgacuacccccaguacagcgaggaggcccgccucaagcgcgaggagaucuccggcgucaagcuggagagcaucgggaccuaccagauccuguccaucuacagcacgguggccuccagccucacccuggccaucauggucgcgggccugucccucuggaugugcagcaacgggucccugcagugccggaucugcauc

SEQ ID NO: 13024 - RNA, 1656 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccaccaacgaccucugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcugaucaagaagaacagcacguaccccaccaucaagaaguccuacaacaacaccaaccaggaggaccuccugguccugugggggauccaccacccgaacgacgccgcggagcagacccggcucuaccagaaccccacgaccuacaucagcaucggcaccuccacccugaaccagcgccuggugcccaagaucgccacgcggagcaaggugaacgggcaguccggccgcauggaguucuucuggaccauccucaaccccaacgacgccaucaacuucgagagcaacgggaacuucaucgccccggaguacgcguacaagaucgucaagaagggcgacagcgccaucaugaaguccgagcuggaguacggcaacugcaacaccaagugccagacccccaugggggccaucaacagcuccaugcccuuccacaacauccacccccugacgaucggcgagugcccgaaguacgugaaguccaaccggcucgugcuggccaccgggcugcgcaacagcccccagcgggagagccgccggaagaagcgcggccucuucggcgccaucgcgggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcauccggaacggcaccuacaacuacccccaguacuccgaggaggcccgccucaagcgggaggagaucagcggggugaagcuggaguccaucggcacguaccagauccugagcaucuacuccaccgucgccagcucccucgcccuggcgaucaugauggccgggcugagccucuggaugugcagcaacggcucccugcagugccgcaucugcauc

SEQ ID NO: 13025 - RNA, 1656 nt, Artificial Sequence; identical to SEQ ID NO: 13020
  derived and/or modified sequence opt1 from anti-influenza_Chain

SEQ ID NO: 13026 - RNA, 1656 nt, Artificial Sequence; identical to SEQ ID NO: 13021
  derived and/or modified sequence opt1 from anti-influenza_Chain

SEQ ID NO: 13027 - RNA, 1656 nt, Artificial Sequence; identical to SEQ ID NO: 13022
  derived and/or modified sequence opt1 from anti-influenza_Chain

SEQ ID NO: 13028 - RNA, 1656 nt, Artificial Sequence; identical to SEQ ID NO: 13023
  derived and/or modified sequence opt1 from anti-influenza_Chain

SEQ ID NO: 13029 - RNA, 1656 nt, Artificial Sequence; identical to SEQ ID NO: 13024
  derived and/or modified sequence opt1 from anti-influenza_Chain

SEQ ID NO: 13030 - RNA, 1680 nt, Artificial Sequence
  derived and/or modified sequence opt1 from anti-influenza_Chain
augagcaacauggacaucgacuccaucaacaccggcaccaucgacaagacgcccgaggagcugaccccggggaccagcggcgccacccgccccaucaucaagcccgccacgcucgcgcccccguccaacaagcggacccgcaaccccagccccgagcggaccaccacguccagcgagaccgacaucgggcgcaagauccagaagaagcagacccccaccgagaucaagaaguccguguacaagauggucgugaagcugggcgaguucuacaaccagaugauggugaaggccgggcugaacgacgacauggagcggaaccucauccagaacgcccaggccgucgagcgcauccugcuggccgcgacggacgacaagaagaccgaguaccagaagaagcggaacgcccgcgacgugaaggagggcaaggaggagaucgaccacaacaagaccggcgggaccuucuacaagauggugcgggacgacaagacgaucuacuucagcccgaucaagaucaccuuccucaaggaggaggucaagaccauguacaagaccacgaugggcuccgacggguucagcggccugaaccacaucaugaucgggcacucccagaugaacgacgugugcuuccagcgcagcaagggccugaagcgggugggccucgaccccucccugaucagcaccuucgccggguccacccugccccgccggagcggcaccacgggggucgccaucaagggcggcgggacccucguggacgaggcgauccgcuucaucggccgggccauggccgaccgcgggcugcugcgggacaucaaggccaagaccgccuacgagaagauccuccugaaccugaagaacaagugcuccgcgccccagcagaaggcccucguggaccaggucaucggcagccgcaacccggggaucgccgacaucgaggaccugacccugcucgcccgguccaugguggugguccgccccagcguggccagcaaggugguccugcccaucuccaucuacgcgaagaucccccagcugggcuucaacacggaggaguacagcauggugggcuacgaggccauggcccucuacaacauggccaccccgguguccauccugcggaugggggacgacgccaaggacaagagccagcuguucuucauguccugcuucggcgcggccuacgaggaccuccgcguccugagcgcccugaccgggaccgaguucaagccccgcuccgcccucaagugcaagggcuuccacgugcccgccaaggagcaggucgaggggaugggcgcggcccugaugagcaucaagcugcaguucugggcccccaugacgcgguccggcgggaacgaggugagcggcgagggcggguccgggcagaucagcugcuccccgguguucgccgucgagcgccccaucgcgcucagcaagcaggccgugcggcgcaugcuguccaugaacguggagggccgggacgccgacgucaagggcaaccugcucaagaugaugaacgacagcauggccaagaagaccuccgggaacgccuucaucggcaagaagauguuccagaucagcgacaagaacaaggugaaccccaucgagauccccaucaagcagaccaucccgaacuucuucuucgggcgcgacaccgcggaggacuacgacgaccuggacuac

SEQ ID NO: 13031 - RNA, 1680 nt, Artificial Sequence
  derived and/or modified sequence opt1 from anti-influenza_Chain
augaacacccagauccuggcccucaucgccuacaugcugaucggcgcgaagggggacaagaucugccugggccaccacgccguggccaacgggaccaaggucaacacgcucaccgagcgcggcaucgagguggugaacgccaccgagaccgucgagacggugaacaucaagaagaucugcacccaggggaagcggcccaccgaccugggccagugcggccugcucgggacccugaucggcccgccccagugcgaccaguuccuggaguucgacgccgaccucaucaucgagcgccgggaggggacggacgugugcuaccccggcaaguucaccaacgaggagagccugcgccagauccugcggggguccggcggcaucgacaaggagagcaugggguucaccuacuccggcauccgcaccaacggggucacgagcgcgugccggcgcuccggcagcuccuucuacgccgagaugaaguggcuccugagcaacuccgacaacgccgccuucccccagaugaccaagagcuaccggaacccgcgcaacaagcccgcgcugaucaucuggggcgugcaccacuccgggagcgccaccgagcagaccaagcucuacggcuccgggaacaagcugaucacggugggcagcuccaaguaccagcagagcuucacccccucccccggggcccggccgcaggucaacggccagagcggccgcaucgacuuccacuggcugcuccuggaccccaacgacaccgugaccuucacguucaacggggccuucaucgcccccgaccgggcguccuucuuccgcggcgagagccugggggugcagagcgacgucccccucgacuccggcugcgagggggacugcuuccacagccggggcaccaucguguccagccugccguuccagaacaucaacccccgcaccgugggcaagugcccccgguacgucaagcagaccucccugcuccuggccacggggaugcgcaacgugcccgagaacccgaagacccggggccuguucggggccaucgccggcuucaucgagaacgggugggagggccucaucgacggcugguacggguuccgccaccagaacgcccagggcgaggggaccgcggccgacuacaagagcacccaguccgccaucgaccagaucacgggcaagcugaaccggcugaucgacaagaccaaccagcaguucgagcucaucgacaacgaguucagcgagaucgagcagcagaucggcaacgugaucaacuggacccgcgacuccaugaccgaggucuggagcuacaacgccgagcugcugguggccauggagaaccagcacacgaucgaccucgcggacuccgagaugaacaagcuguacgagcgcgugcggaagcagcugcgcgagaacgccgaggaggacgggaccggcugcuucgagaucuuccacaagugcgacgaccagugcauggagagcauccggaacaacaccuacgaccacacccaguaccgcacggagucccuccagaaccggauccagaucgaccccgucaagcugagcuccggguacaaggacaucauccugugguucagcuucggcgccuccugcuuccuccugcuggccaucgccauggggcucguguucaucugcaucaagaacggcaacaugcgcugcaccaucugcauc

SEQ ID NO: 13032 - RNA, 1680 nt, Artificial Sequence
  derived and/or modified sequence opt1 from anti-influenza_Chain
augaacacccagauccuggcccucaucgccugcaugcugaucggcgcgaagggggacaagaucugccugggccaccacgccguggccaacgggaccaaggucaacacgcucaccgagcgcggcaucgagguggugaacgccaccgagaccgucgagacggccaacaucaagaagaucugcacccaggggaagcggcccaccgaccugggccagugcggccugcucgggacccugaucggcccgccccagugcgaccaguuccuggaguucgacgcggaccucaucaucgagcgccgggaggggacggacgugugcuaccccggcaaguucaccaacgaggagagccugcgccagauccugcggggguccggcggcaucgacaaggagagcaugggguucaccuacuccggcauccgcaccaacggggccacgagcgccugccggcgcuccggcagcuccuucuacgccgagaugaaguggcuccugagcaacuccgacaacgcggccuucccccagaugaccaagagcuaccggaacccgcgcaacaagcccgcccugaucaucuggggcgugcaccacuccgggagcgccaccgagcagaccaagcucuacggcuccgggaacaagcugaucacggucggcagcuccaaguaccagcagagcuucacccccucccccggggcccggccccaggugaacggccagagcggccgcaucgacuuccacuggcugcuccuggacccgaacgacaccgugaccuucacguucaacggggcguucaucgcccccgaccgggccuccuucuuccgcggcgggagccugggcguccagagcgacgugccccucgacuccgggugcgagggcgacugcuuccacagcggcgggaccaucguguccagccugccguuccagaacaucaacccccggaccgucggcaagugcccccgcuacgugaagcagaccucccugcuccuggccacggggaugcggaacgugcccgagaacccgaagacccgcggccuguucggggccaucgcgggcuucaucgagaacggcugggaggggcucaucgacggcugguacggguuccggcaccagaacgcccagggcgagggcaccgccgccgacuacaagagcacccaguccgccaucgaccagaucacggggaagcugaaccgccugaucgacaagaccaaccagcaguucgagcucaucgacaacgaguucaacgagaucgagcagcagaucggcaacgucaucaacuggacccgggacagcaugaccgaggugugguccuacaacgcggagcugcugguggccauggagaaccagcacacgaucgaccucgccgacagcgagaugaacaagcuguacgagcgcguccgcaagcagcugcgggagaacgccgaggaggacgggaccggcugcuucgagaucuuccacaagugcgacgaccagugcauggaguccauccgcaacaacaccuacgaccacacccaguaccggacggagagccuccagaaccgcauccagaucaaccccgugaagcuguccagcggguacaaggacaucauccugugguucuccuucggcgccagcugcuuccuccugcuggcgaucgccaugggccucguguucaucugcaucaagaacgggaacaugcggugcaccaucugcauc

SEQ ID NO: 13033 - RNA, 1680 nt, Artificial Sequence
  derived and/or modified sequence opt1 from anti-influenza_Chain
auggagcgcaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccgcaucaaccacuucgagcggauccagaucauccccaagagcuccuggagcgaccacgaggccuccagcggcgucuccagcgccugcccguaccagggccgcuccagcuucuuccggaacgugguguggcugaucaagaagaacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaacugccagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccgcugcgacaacgagugcauggaguccguccggaacgggaccuacgacuacccccaguacagcgaggaggcccgccugaagcgggaggagaucuccggcgugaagcuggagagcaucgggaccuaccagauccucuccaucuacagcacgguggccuccagccuggcgcuggccaucauggucgccggccucucccuguggaugugcagcaacggg

SEQ ID NO: 13034 - RNA, 1680 nt, Artificial Sequence; identical to SEQ ID NO: 13030
  derived and/or modified sequence opt1 from anti-influenza_Chain

SEQ ID NO: 13035 - RNA, 1680 nt, Artificial Sequence; identical to SEQ ID NO: 13031
  derived and/or modified sequence opt1 from anti-influenza_Chain

SEQ ID NO: 13036 - RNA, 1680 nt, Artificial Sequence; identical to SEQ ID NO: 13032
  derived and/or modified sequence opt1 from anti-influenza_Chain

SEQ ID NO: 13037 - RNA, 1680 nt, Artificial Sequence; identical to SEQ ID NO: 13033
  derived and/or modified sequence opt1 from anti-influenza_Chain

SEQ ID NO: 13038 - RNA, 1686 nt, Artificial Sequence
  derived and/or modified sequence opt1 from anti-influenza_Chain
augccccgcgcccugcggcgcgugccgggcagccgggucaugcuccgcguggggguggucguggccgugcuggcgcuggucgccgcccucgccaaccuggccgugccccggcccgcgcgcgccgccggcgggggcuacuggcacaccuccgggcgggagauccuggacgccaacaacgugcccguccgcaucgcgggcaucaacugguucggcuucgagaccugcaacuacguggugcacgggcucuggagccgggacuaccgcuccaugcuggaccagaucaagagccugggcuacaacacgauccggcucccguacuccgacgacauccugaagcccgggaccaugcccaacagcaucaacuucuaccagaugaaccaggaccugcagggccucaccucccugcaggucauggacaagaucguggccuacgccgggcagaucggccugcgcaucauccucgaccggcaccgccccgacugcagcggccaguccgcccugugguacaccagcuccgugagcgaggccacguggaucuccgaccugcaggcgcucgcccagcgguacaaggggaacccgaccgucgugggcuucgaccugcacaacgagccccacgaccccgccugcugggggugcggcgaccccagcaucgacuggcgccuggccgccgagcgggcgggcaacgccgugcucuccgucaacccgaaccugcugaucuucguggagggggugcagagcuacaacggcgacuccuacugguggggcgggaaccuccagggggccggccaguaccccgucgugcugaacgugcccaaccgccuggucuacagcgcccacgacuacgccaccuccguguacccccagaccugguucagcgacccgacguuccccaacaacaugcccggcaucuggaacaagaacuggggguaccucuucaaccagaacaucgcgcccgucuggcugggcgaguucgggaccacccugcagagcaccacggaccagaccuggcucaagacccuggugcaguaccugcggccgaccgcccaguacggcgccgacuccuuccaguggacguucuggagcuggaaccccgacuccggggacaccggcggcauccucaaggacgacuggcagaccguggacaccgucaaggacggguaccuggcccccaucaagagcuccaucuucgaccccgugggcgccagcgcguccccgagcucccagcccagccccuccgugagccccuccccgagccccucccccagcgccucccgcacgccgacccccacccccacccccacggccagcccgacccccacccugacccccacggccacccccaccccgaccgcgucccccacgcccagccccaccgccgccagcggggcccggugcaccgccuccuaccaggucaacagcgacuggggcaacggguucaccgugacgguggcggucaccaacuccggcagcguggccaccaagaccuggaccguguccuggacguucggcgggaaccagaccaucaccaacagcuggaacgccgccgucacccagaacggccaguccgugacggcccgcaacaugagcuacaacaacgugauccagccggggcagaacaccaccuucggcuuccaggcguccuacaccggcagcaacgccgcccccacggucgccugcgccgcgucc

SEQ ID NO: 13039 - RNA, 1686 nt, Artificial Sequence
  derived and/or modified sequence opt1 from anti-influenza_Chain
auggagcgcgugugguggaaggaggccgucguguaccagaucuacccccggagcuucuacgacuccaacggcgacgggaucggcgacauccgcgggaucaucgccaagcuggacuaccucaaggagcugggcguggacgucguguggcugagcccgguguacaagucccccaacgacgacaacggguacgacaucagcgacuaccgggacaucauggacgaguucggcaccauggcggacuggaagaccaugcucgaggagaugcacaagcgcggcaucaagcuggucauggaccugguggugaaccacacguccgacgagcaccccugguucaucgagagccggaaguccaaggacaaccccuaccgcgacuacuacaucuggcggccggggaagaacggcaaggagcccaacaacugggagagcgucuucuccgggagcgccugggaguacgacgagaugaccggcgaguacuaccuccaccuguucuccaagaagcagcccgaccugaacugggagaaccccaaggugcgccgggagguguacgagaugaugaaguucuggcucgacaagggggucgacggcuuccgcauggacgugaucaacaugaucagcaaggugccggagcugcccgacggcgagccccaguccgggaagaaguacgccagcggcucccgguacuacaugaacgggccccgcguccacgaguuccugcaggagaugaaccgggaggugcucagcaaguacgacaucaugaccgugggcgagaccccgggcgucacgcccaaggaggggauccuguacaccgaccccucccgccgggagcugaacaugguguuccaguucgagcacauggaccucgacagcggccccgggggcaagugggacauccgcccguggucccuggccgaccugaagaagaccaugaccaaguggcagaaggagcucgaggggaagggcuggaacagccuguaccugaacaaccacgaccagccccgggccgugagccgcuucggcgacgacgggaaguaccgggucgaguccgcgaagaugcucgccacguuccugcacaugaugcagggcacccccuacaucuaccagggggaggagaucggcaugaccaacgugcgcuuccccagcaucgaggacuaccgggacaucgagacccugaacauguacaaggagcgcguggaggaguacggggaggacccgcaggaggucauggagaagaucuacuacaagggccgcgacaacgcccggacgcccaugcagugggacgacuccgagaacgccggcuucaccgcggggacccccuggauccccgugaacccgaacuacaaggagaucaacgucaaggccgcccucgaggaccccaacagcguguuccacuacuacaagaagcugauccagcugcgcaagcagcacgacaucaucguguacggcaccuacgaccucauccuggaggacgaccccuacaucuaccgguacacgcgcacccuggggaacgagcagcucaucgucaucaccaacuucuccgagaagacccccguguuccggcugccggaccacaucaucuacaagacgaaggagcugcucaucagcaacuacgacguggacgaggccgaggagcugaaggagauccgccugcggcccugggaggcccgcgucuacaagauccggcucccc

SEQ ID NO: 13040 - RNA, 1686 nt, Artificial Sequence; identical to SEQ ID NO: 13038
  derived and/or modified sequence opt1 from anti-influenza_Chain

SEQ ID NO: 13041 - RNA, 1686 nt, Artificial Sequence; identical to SEQ ID NO: 13039
  derived and/or modified sequence opt1 from anti-influenza_Chain

SEQ ID NO: 13042 - RNA, 1689 nt, Artificial Sequence
  derived and/or modified sequence opt1 from anti-influenza_Chain
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaagaccuccuucuuccgcaacguggucuggcugaucaagaagaacagcaccuaccccacgaucaagcgguccuacaacaacaccaaccaggaggaccuccuggugcugugggggauccaccaccccaacgacgcggccgagcagaccaagcucuaccagaacccgaccacguacaucagcgugggcaccuccacccugaaccagcgccuggucccccggaucgccacccgcagcaaggugaacgggcaguccggccggauggaguucuucuggacgauccucaagcccaacgacgccaucaacuucgagagcaacgggaacuucaucgcgcccgaguacgccuacaagaucgugaagaagggcgacagcaccaucaugaaguccgagcuggaguacggcaacugcaacaccaagugccagaccccgaugggggccaucaacagcuccaugcccuuccacaacauccacccccugacgaucggcgagugccccaaguacgucaagagcaaccgccucgugcuggccaccgggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgucacgaacaaggugaacuccaucaucgacaagaugaacacccaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcacguacgacuacccccaguacagcgaggaggcccggcucaagcgcgaggagaucuccggggucaagcuggagagcaucggcaucuaccagauccuguccaucuacagcaccguggccuccagccucgcccuggcgaucaugguggccgggcugucccucuggaugugcagcaacggcagccugcagugccggaucugc

SEQ ID NO: 13043 - RNA, 1689 nt, Artificial Sequence; identical to SEQ ID NO: 13042
  derived and/or modified sequence opt1 from anti-influenza_Chain

SEQ ID NO: 13044 - RNA, 1692 nt, Artificial Sequence
  derived and/or modified sequence opt1 from anti-influenza_Chain
auggagaagaucgugcuccuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcucccugaacggcgugaagccccugauccuccgcgacugcagcgucgccggguggcugcugggcaacccgaugugcgacgaguuccucaacgugcccgagugguccuacaucguggagaaggacagccccaucaacgggcugugcuaccccggcgacuucaacgacuacgaggagcugaagcaccuccuguccagcaccaaccacuucgagaagauccagaucaucccgcgguccagcugguccgaccacgacgccagcuccggcgucagcuccgccugccccuacaacgggcgcagcuccuucuuccggaacgugguguggcugaucaagaagaacaacgccuaccccacgaucaagcgcaacuacaacaacaccaaccaggaggaccuccugguccuguggggcauccaccaccccaacgacgcgaccgagcagaccaagcucuaccagaacccgacgaccuacgugagcguggggaccuccacccugaaccagcggagcguccccgagaucgccacgcgccccaaggugaacggccagagcgggcggaucgaguucuucuggaccauccugaagcccaacgacgccaucaacuucgaguccaacggcaacuucaucgccccggaguacgcguacaagaucgccaagaagggcgacagcgccaucaugaaguccgggcucgaguacggcaacugcaacaccaagugccagacccccaugggggccaucaacagcuccaugcccuuccacaacauccacccccugacgaucggcgagugcccgcgcuacgucaagagcgaccggcuggugcucgccaccggccugcgcaacgugccccagcgggagacccgcgggcuguucggcgcgaucgccggguucaucgagggcggguggcagggcaugguggacggcugguacggguaccaccacuccaacgagcagggcagcggguacgccgccgacaaggaguccacccagaaggccaucgacggcaucacgaacaaggucaacagcaucaucgacaagaugaacacccaguucgaggcgguggggaaggaguucaacaaccucgagcggcgcaucgagaaccugaacaagaagauggaggacggcuuccuggacguguggaccuacaacgccgagcuccugguccugauggagaacgagcggacccucgacuuccacgacuccaacgugaagaaccuguacgacaagguccgccugcagcuccgggacaacgccaaggagcugggcaacgggugcuucgaguucuaccacaagugcgacgacgagugcauggagagcgugcgcaacggcacguacgacuacccccaguacuccgaggaggcccggcugaaccgcgaggagaucagcggggugaagcucgaguccaucggcaccuaccagauccugagcaucuacuccaccgucgccagcucccuggcgcucgccaucaugguggccgggcugagcuucuggaugugcagcaacggcucccugcagugccggaucugcauc

SEQ ID NO: 13045 - RNA, 1692 nt, Artificial Sequence; identical to SEQ ID NO: 13044
  derived and/or modified sequence opt1 from anti-influenza_Chain

SEQ ID NO: 13046 - RNA, 1695 nt, Artificial Sequence
  derived and/or modified sequence opt1 from anti-influenza_Chain
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccaccaucaagcggagcuacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagagcaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacccaguucgaggccguggggcgggaguucaacaaccuggagcgccggaucgagaaccugaacaagaagauggaggacggcuuccucgacgucuggacguacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccaccguggccagcucccucgcccuggcgaucaugguggccgggcugagccucuggaugugcagcaacggcucccugcagugccgg

SEQ ID NO: 13047 - RNA, 1695 nt, Artificial Sequence
  derived and/or modified sequence opt1 from anti-influenza_Chain
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccgg

SEQ ID NO: 13048 - RNA, 1695 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcaaguccagcuucuuccgcaacgugguguggcugaucaagaagaacuccagcuaccccaccaucaagcgguccuacaacaacacgaaccaggaggaccuccugguccugugggggauccaccaccccaacgacgccgccgagcagacccgccucuaccagaacccgaccaccuacaucagcgugggcacguccacccugaaccagcggcuggugcccaagaucgccacccgcagcaaggucaacgggcagagcggccggauggaguucuucuggaccauccucaagcccaacgacgcgaucaacuucgaguccaacgggaacuucaucgcccccgaguacgccuacaagaucgugaagaagggcgacagcgccaucaugaaguccgagcuggaguacggcaacugcaacacgaagugccagaccccgaugggggccaucaacagcuccaugcccuuccacaacauccacccccugaccaucggcgagugccccaaguacgucaagagcaaccgccucgugcuggcgaccgggcugcggaacuccccgcagcgcgagcggcgccggaagaagcgcggccucuucggcgccaucgccggguucaucgagggcggguggcagggcaugguggacgggugguacggcuaccaccacagcaacgagcagggcuccggguacgccgccgacaaggagagcacgcagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgcgaggagaucuccggggugaagcuggagagcaucggcaucuaccagauccuguccaucuacagcaccgucgcguccagccucgcccuggccaucaugguggccgggcugagccucuggaugugcuccaacggcagccugcagugccgg

SEQ ID NO: 13049 - RNA, 1695 nt, Artificial Sequence
  derived and/or modified sequence opt1 from anti-influenza_Chain
augagcgaccgccggcagaaccgcaagacccccgacgagcagcggaaggccaacgcccugaucaucaacgagaacaucgaggcguacaucgccaucugcaaggaggugggccucaacggggacgagaugcugauccuggagaacggcaucgccaucgagaaggccauccgcaucugcugcgacgggaaguaccaggagaagcgggagaagaaggcccgcgaggcgcagcgggccgacuccaacuucaacgccgacagcaucggcauccgccucgucaagcgggccggguccggcaccaacaucacguaccacgcggugguggagcugaccagccgcucccggaucguccagauccucaagagccacuggggcaacgagcugaaccgcgccaagaucgccgggaagcggcugggcuucuccgcccuguucgccagcaaccucgaggcgaucaucuaccagcgcgggcggaacgccgcccgccggaacggcuccgccgagcuguucacccugacccagggggccggcaucgagacgcgcuacaaguggaucauggagaagcacaucggcaucggggugcucaucgcggacgccaagggccugaucaacgggaagcgggagggcaagcgcggcguggacgccaacgucaagcugcgggccgggaccaccggcagcccgcucgagcgcgccaugcaggggaucgagaagaaggcguuccccggcccccugcgcgcccuggcccggcgcguggugaaggccaacuacaacgacgcccgggaggcgcucaacgucaucgccgaggccucccugcugcucaagccccagaucaccaacaagaugacgaugccguggugcauguggcuggccgcgcgccugacccucaaggacgaguucgccaacuucugcgccuacgccgggcggcgcgccuucgagguguucaacaucgcgauggagaagaucggcaucugcagcuuccagggcaccaucaugaacgacgacgagaucgaguccaucgaggacaaggcccaggugcugaugauggccugcuucgggcuggccuacgaggacuucagccucgucuccgccauggugagccacccccugaagcugcggaaccgcaugaagaucggcaacuuccgggugggggagaaggucuccaccgugcucagcccccugcugcgcuucacgcggugggcggaguucgcccagcgcuucgcccuccaggccaacaccucccgggagggcgcccagaucagcaacagcgcgguguucgccgucgagcgcaagaucaccaccgacgugcagcggguggaggagcugcugaacaagguccaggcccacgaggacgagccccuccagacgcuguacaagaaggugcgcgagcagaucuccaucaucgggcggaacaagagcgagaucaaggaguuccugggcuccagcauguacgaccucaacgaccaggagaagcagaacccgaucaacuuccgcuccggcgcccaccccuucuucuucgaguucgaccccgacuacaaccccauccgggugaagcgcccgaagaagcccaucgcgaagcgcaacagcaacaucucccggcuggaggaggaggggauggacgagaacagcgagaucggccaggccaagaagaugaagccccuggaccagcucaccuccaccagcuccaacauccccgggaagaac

SEQ ID NO: 13050 - RNA, 1695 nt, Artificial Sequence
  derived and/or modified sequence opt1 from anti-influenza_Chain
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuaccacuggacccuccuggagcccggggacaccaucaucuucgaggcgaacggcaaccugaucgccccgcgguacgccuucacccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcauc

SEQ ID NO: 13051 - RNA, 1695 nt, Artificial Sequence
  derived and/or modified sequence opt1 from anti-influenza_Chain
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcauc

SEQ ID NO: 13052 - RNA, 1695 nt, Artificial Sequence
  derived and/or modified sequence opt1 from anti-influenza_Chain
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccgacaucggcgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcauc

SEQ ID NO: 13053 - RNA, 1695 nt, Artificial Sequence
  derived and/or modified sequence opt1 from anti-influenza_Chain
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcauc

SEQ ID NO: 13054 - RNA, 1695 nt, Artificial Sequence
  derived and/or modified sequence opt1 from anti-influenza_Chain
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcauc

SEQ ID NO: 13055 - RNA, 1695 nt, Artificial Sequence
  derived and/or modified sequence opt1 from anti-influenza_Chain
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacaaggagaacgccuacgugagcguggucagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacagcgugaucgagaagaugaacacccaguucaccgccgucgggaaggaguucaacaagcuggagcgccggauggagaaccucaacaagaagguggacgacggcuucaucgacaucuggaccuacaacgccgagcugcugguccuccuggagaacgagcgcacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacagcaccgucgccagcucccuggugcuccuggugagccugggggccaucuccuucuggaugugcagcaacggcucccuccagugccgcaucugcauc

SEQ ID NO: 13056 - RNA, 1677 nt, Artificial Sequence
  derived and/or modified sequence opt1 from anti-influenza_Chain
gacaagaucugcaucggcuaccagagcaccaacuccaccgagacgguggacacccugaccaagaccaacguccccgugacgcaggccaaggagcuccugcacaccgagcacaacgggaugcugugcgccaccaaccucggccacccgcugauccuggacacgugcaccaucgaggggcucaucuacggcaaccccagcugcgaccugcugcucgggggccgcgagugguccuacaucguggagcggcccagcgcggucaacggcaugugcuaccccgggaacguggagaaccuggaggagcugcgccuccuguucuccagcgccuccagcuaccagcgggugcagaucuucccggacaccaucuggaacgucaccuacuccggcaccagcuccgccugcagcaacuccuucuaccgcagcaugcgguggcugacgcagaaggacaacaccuaccccgugcaggacgcccaguacaccaacaaccgcgggaaguccauccucuucauguggggcaucaaccacccgcccaccgacacggugcagaccaaccuguacacccggaccgacacgaccaccagcgucaccacggaggacaucaaccgcgccuucaagcccgugaucgggccccggccccuggugaacggccuccagggccgcaucgacuacuacugguccguccugaagcccgggcagacccugcgggugcgcagcaacggcaaccucaucgcgccgugguacgggcacauccuguccggcgagagccacggccggauccucaagagcgaccugaacuccgggaacugcgugguccagugccagaccgagcgcggcgggcugaacaccacgcugcccuuccacaacgugagcaaguacgccuucggcaacugccccaaguacgugggggucaagucccucaagcuggccgugggcaugcggaacgugcccgcccgcagcucccggggccuguucggggcgaucgccggcuucaucgagggcggguggccggggcucgucgccggcugguacggcuuccagcacagcaacgaccagggggugggcauggccgccgaccgcgacuccacccagaaggcgaucgacaagaucaccagcaaggugaacaacaucgucgacaagaugaacaagcaguacgagaucaucgaccacgaguucuccgagaucgagacccggcugaacaugaucaacaacaagaucgacgaccagauccaggacaucugggccuacaacgccgagcugcucgugcugcuggagaaccagaagacgcucgacgagcacgacgccaacgucaacaaccuguacaacaaggugaagcgcgcccuggggagcaacgcgauggaggacggcaaggggugcuucgagcucuaccacaagugcgacgaccggugcauggagaccauccgcaacggcaccuacaaccgcggcaaguacaaggaggagucccggcuggagcgccagaagaucgagggggugaagcuggagagcgagggcaccuacaaguccgggcggcucgucccccgcggcagccccggcuccggguacauccccgaggccccgcgggacggccaggccuacgugcgcaaggacggggagugggugcugcugagcacguuccucggcaagcccauccccaacccccugcuggggcucgacuccaccggc

SEQ ID NO: 13057 - RNA, 1677 nt, Artificial Sequence; identical to SEQ ID NO: 13056
  derived and/or modified sequence opt1 from anti-influenza_Chain

SEQ ID NO: 13058 - RNA, 1695 nt, Artificial Sequence; identical to SEQ ID NO: 13049
  derived and/or modified sequence opt1 from anti-influenza_Chain

SEQ ID NO: 13059 - RNA, 1695 nt, Artificial Sequence; identical to SEQ ID NO: 13046
  derived and/or modified sequence opt1 from anti-influenza_Chain

SEQ ID NO: 13060 - RNA, 1695 nt, Artificial Sequence; identical to SEQ ID NO: 13047
  derived and/or modified sequence opt1 from anti-influenza_Chain

SEQ ID NO: 13061 - RNA, 1695 nt, Artificial Sequence; identical to SEQ ID NO: 13048
  derived and/or modified sequence opt1 from anti-influenza_Chain

SEQ ID NO: 13062 - RNA, 1695 nt, Artificial Sequence; identical to SEQ ID NO: 13050
  derived and/or modified sequence opt1 from anti-influenza_Chain

SEQ ID NO: 13063 - RNA, 1695 nt, Artificial Sequence; identical to SEQ ID NO: 13051
  derived and/or modified sequence opt1 from anti-influenza_Chain

SEQ ID NO: 13064 - RNA, 1695 nt, Artificial Sequence; identical to SEQ ID NO: 13052
  derived and/or modified sequence opt1 from anti-influenza_Chain

SEQ ID NO: 13065 - RNA, 1695 nt, Artificial Sequence; identical to SEQ ID NO: 13053
  derived and/or modified sequence opt1 from anti-influenza_Chain

SEQ ID NO: 13066 - RNA, 1695 nt, Artificial Sequence; identical to SEQ ID NO: 13054
  derived and/or modified sequence opt1 from anti-influenza_Chain

SEQ ID NO: 13067 - RNA, 1695 nt, Artificial Sequence; identical to SEQ ID NO: 13055
  derived and/or modified sequence opt1 from anti-influenza_Chain

SEQ ID NO: 13068 - RNA, 1698 nt, Artificial Sequence
  derived and/or modified sequence opt1 from anti-influenza_Chain
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccguccaucggcagccggccccgcauccgggacguccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcauc

SEQ ID NO: 13069 - RNA, 1698 nt, Artificial Sequence
  derived and/or modified sequence opt1 from anti-influenza_Chain
augaagaccaucaucgcccugagcuacauccucugccugguguccgcccagaaguuccccggcaacgacaacagcaccgcgacgcugugccucgggcaccacgccgucccgaacggcaccaucgugaagaccaucaccaacgaccagaucgaggugacgaacgccaccgagcugguccaguccagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacauccggucccgcccccggguccgcaacauccccagccggaucuccaucuacuggaccaucgugaagcccggcgacauccugcugaucaacagcaccggcaaccucaucgccccgcgcggguacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggcgccugcccccgcuacgucaagcagaacacccugaagcuggcgaccgggaugcggaacgugcccgagaagcagacgcgcggcaucuucggggccaucgccggcuucaucgagaacgggugggagggcaugguggacggcugguacggguuccggcaccagaacuccgagggcaucgggcaggccgccgaccucaagagcacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaagggcaacauccggugcaacaucugcauc

SEQ ID NO: 13070 - RNA, 1698 nt, Artificial Sequence
  derived and/or modified sequence opt1 from anti-influenza_Chain
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaaggagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggcugcgcguccgggacauccccucccgcaucagcaucuacuggaccaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacacgaagaucgaccucugguccuacaacgccgagcugcugguggcccucgagaaccagcacaccaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcacguacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcauc

SEQ ID NO: 13071 - RNA, 1698 nt, Artificial Sequence
  derived and/or modified sequence opt1 from anti-influenza_Chain
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaagugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcauc

SEQ ID NO: 13072 - RNA, 1698 nt, Artificial Sequence
  derived and/or modified sequence opt1 from anti-influenza_Chain
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcauc

SEQ ID NO: 13073 - RNA, 1698 nt, Artificial Sequence
  derived and/or modified sequence opt1 from anti-influenza_Chain
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggagccucgucgcguccagcgggacgcuggaguucaacaacgaguccuucaacugggccggcgugacccagaacgggaccagcuccgccugcaagcgccggagcaacaaguccuucuucagccgccugaacuggcucacccaccugaaguacaaguaccccgcccugaacgugacgaugcccaacaacgagaaguucgacaagcucuacaucuggggcguccaccaccccgugaccgacuccgaccagaucagccuguacgcgcaggccagcgggcggaucaccguguccaccaagcgcagccagcagacggucaucccgaacaucggcuaccggccccgcgugcgggacaucuccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgagagcauccgcaacgggaccuacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcauc

SEQ ID NO: 13074 - RNA, 1698 nt, Artificial Sequence
  derived and/or modified sequence opt1 from anti-influenza_Chain
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacgacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcagccagcagaccgucaucccgaacaucggcucccggccccgcauccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcauc

SEQ ID NO: 13075 - RNA, 1698 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucugggccauccugaagcccaacgacgcgaucaacuucgaguccaacgggaacuucaucgccccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucaccaucggcgagugcccgaaguacgugaaguccaaccggcuggugcuggcgacggggcuccgcaacagcccccagcgggagagccgccggaagaagcgcggccuguucggcgccaucgccggguucaucgagggcggguggcagggcauggucgacgggugguacggcuaccaccacuccaacgagcagggcagcggguacgccgccgacaaggaguccacccagaaggcgaucggcgugaccaacaaggugaacagcaucaucgacaagaugaacacccaguucgaggccgucgggcgggaguucaacaaccuggagcgccggaucgagaaccucaacaagaagauggaggacggcuuccuggacguguggacguacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacccccaguacuccgaggaggcccgccugaagcgggaggagaucagcggggucaagcuggaguccaucggcaccuaccagauccucagcaucuacuccacgguggcgagcagccuggcccuggccaucaugaucgccgggcucucccuguggaugugcagcaacggcucccugcagugccgcaucugcauc

SEQ ID NO: 13076 - RNA, 1698 nt, Artificial Sequence
  derived and/or modified sequence opt1 from anti-influenza_Chain
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcauc

SEQ ID NO: 13077 - RNA, 1698 nt, Artificial Sequence
  derived and/or modified sequence opt1 from anti-influenza_Chain
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcagcucccgguacagcaagaaguucaagcccgagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcauc

SEQ ID NO: 13078 - RNA, 1698 nt, Artificial Sequence; identical to SEQ ID NO: 13075
  derived and/or modified sequence opt1 from anti-influenza_Chain

SEQ ID NO: 13079 - RNA, 1698 nt, Artificial Sequence; identical to SEQ ID NO: 13068
  derived and/or modified sequence opt1 from anti-influenza_Chain

SEQ ID NO: 13080 - RNA, 1698 nt, Artificial Sequence; identical to SEQ ID NO: 13076
  derived and/or modified sequence opt1 from anti-influenza_Chain

SEQ ID NO: 13081 - RNA, 1698 nt, Artificial Sequence; identical to SEQ ID NO: 13077
  derived and/or modified sequence opt1 from anti-influenza_Chain

SEQ ID NO: 13082 - RNA, 1698 nt, Artificial Sequence; identical to SEQ ID NO: 13069
  derived and/or modified sequence opt1 from anti-influenza_Chain

SEQ ID NO: 13083 - RNA, 1698 nt, Artificial Sequence; identical to SEQ ID NO: 13070
  derived and/or modified sequence opt1 from anti-influenza_Chain

SEQ ID NO: 13084 - RNA, 1698 nt, Artificial Sequence; identical to SEQ ID NO: 13071
  derived and/or modified sequence opt1 from anti-influenza_Chain

SEQ ID NO: 13085 - RNA, 1698 nt, Artificial Sequence; identical to SEQ ID NO: 13072
  derived and/or modified sequence opt1 from anti-influenza_Chain

SEQ ID NO: 13086 - RNA, 1698 nt, Artificial Sequence; identical to SEQ ID NO: 13073
  derived and/or modified sequence opt1 from anti-influenza_Chain

SEQ ID NO: 13087 - RNA, 1698 nt, Artificial Sequence; identical to SEQ ID NO: 13074
  derived and/or modified sequence opt1 from anti-influenza_Chain

SEQ ID NO: 13088 - RNA, 1683 nt, Artificial Sequence
  derived and/or modified sequence opt1 from anti-influenza_Chain
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccagcacagcgggggccgguccagccuggaggggccccgcuucgagcagaagcucaucuccgaggaggaccugaacaugcacacgggc

SEQ ID NO: 13089 - RNA, 1683 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcaaguccagcuucuuccgcaacgugguguggcugaucaagaagaacuccagcuaccccaccaucaagcgguccuacaacaacacgaaccaggaggaccuccugguccugugggggauccaccaccccaacgacgccgccgagcagacccgccucuaccagaacccgaccaccuacaucagcgugggcacguccacccugaaccagcggcuggugcccaagaucgccacccgcagcaaggucaacgggcagagcggccggauggaguucuucuggaccauccucaagcccaacgacgcgaucaacuucgaguccaacgggaacuucaucgcccccgaguacgccuacaagaucgugaagaagggcgacagcgccaucaugaaguccgagcuggaguacggcaacugcaacacgaagugccagaccccgaugggggccaucaacagcuccaugcccuuccacaacauccacccccugaccaucggcgagugccccaaguacgucaagagcaaccgccucgugcuggcgaccgggcugcggaacuccccgcagcgcgagcggcgccggaagaagcgcggccucuucggcgccaucgccggguucaucgagggcggguggcagggcaugguggacgggugguacggcuaccaccacagcaacgagcagggcuccggguacgccgccgacaaggagagcacgcagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgcgaggagaucuccggggugaagcuggagagcaucggcaucuaccagauccagcacuccgggggccggagcucccuggaggggccccgcuucgagcagaagcucaucagcgaggaggaccugaacaugcacaccggc

SEQ ID NO: 13090 - RNA, 1701 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucaucagcaaguccagcugguccgaccacgaggccagcuccggcgucagcuccgcgugcccguaccagggcacccccagcuucuuccgcaacgugguguggcugaucaagaagaacaacacguaccccaccaucaagcgguccuacaacaacaccaaccaggaggaccuccugauccugugggggauccaccacagcaacaacgccgccgagcagaccaagcucuaccagaaccccacgaccuacaucuccgucggcaccagcacccugaaccugcgccucgugccgaagaucgccacgcgguccaaggugaacgggcagagcggccgcauggacuucuucuggaccauccugaagcccaacgacgcgaucaacuucgagagcaacgggaacuucaucgcccccgaguacgccuacaagaucgucaagaagggcgacuccgccaucaugaaguccgagguggaguacggcaacugcaacaccaagugccagacccccaucggggccaucaacagcagcaugccguuccacaacauccacccccugacgaucggcgagugccccaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacuccaacgagcagggcagcggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccacaagugcgacaacgagugcauggagagcgugcggaacggcaccuacgacuacccgcaguacuccgaggaggcccgccugaagcgggaggagaucagcggggugaagcuggaguccaucggcacguaccagauccucagcaucuacuccaccgucgcgagcucccuggcccuggccaucaugguggccgggcucagccuguggaugugcagcaacggcucccugcagugccgcaucugcauc

SEQ ID NO: 13091 - RNA, 1701 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcaguccggccgcauggacuucuucuggaccauccucaagcccaacgacgcgaucaacuucgagagcaacgggaacuucaucgcccccgaguacgccuacaagaucgucaagaagggcgacagcgccaucgugaaguccgagguggaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgucaccaacaaggugaacuccaucaucgacaagaugaacacgcaguucgaggccguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacagcaacgucaagaaccuguacgacaaggugcggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggucaagcuggagagcaucggcacguaccagauccuguccaucuacagcaccguggcguccagccucgcccuggccaucaugguggccgggcugucccucuggaugugcagcaacggcagccugcagugccgcaucugcauc

SEQ ID NO: 13092 - RNA, 1683 nt, Artificial Sequence
  derived and/or modified sequence opt1 from anti-influenza_Chain
gacaagaucugccugggccaccacgccgugagcaacgggaccaaggucaacacccucacggagcgcggcguggagguggucaacgccaccgagaccguggagcggaccaacgugccccgcaucugcuccaaggggaagcggacggucgaccugggccagugcgggcugcucggcaccaucaccggcccgccccagugcgaccaguuccuggaguucagcgccgaccugaucaucgagcgccgggagggguccgacgugugcuaccccggcaaguucgugaacgaggaggcccuccgccagauccugcgggagagcgggggcaucgacaaggagaccaugggguucacguacuccggcauccgcaccaacggcaccaccagcgccugccggcgcuccgggagcuccuucuacgccgagaugaaguggcugcucagcaacacggacaacgccgcguucccccagaugaccaaguccuacaagaacacccggaaggacccggcccugaucaucuggggcauccaccacagcggguccaccacggagcagaccaagcuguacggcagcggcaacaagcucaucaccgucggguccagcaacuaccagcaguccuucgugcccagccccggcgcccgcccccaggugaacgggcaguccggccggaucgacuuccacuggcugauccugaacccgaacgacaccgucacguucagcuucaacggggccuucaucgcgcccgaccgcgccagcuuccuccggggcaaguccaugggcauccagagcgagguccagguggacgccaacugcgagggggacugcuaccacuccggcgggaccaucaucagcaaccugcccuuccagaacaucaacucccgcgccgugggcaagugcccccgguacgugaagcaggagagccugcuccuggccaccgggaugaagaacgugccggagauccccaagcgccggcgccggggccuguucggcgcgaucgccggguucaucgagaacggcugggaggggcucaucgacggcugguacggguuccgccaccagaacgcccagggcgagggcaccgccgccgacuacaaguccacgcagagcgcgaucgaccagaucaccgggaagcugaaccgccugaucgagaagaccaaccagcaguucgagcucaucgacaacgaguucaccgaggucgagcggcagaucggcaacgugaucaacuggacgcgcgacuccaugaccgagguguggagcuacaacgccgagcugcuggucgccauggagaaccagcacaccaucgaccucgccgacuccgagaugaacaagcuguacgagcgggugaagcgccagcugcgggagaacgccgaggaggacgggaccggcugcuucgagaucuuccacaagugcgacgacgacugcauggcgagcauccgcaacaacacguacgaccacuccaaguaccgggaggaggccauccagaaccgcauccagaucgaccccgugaagcucagcuccggcuacaaggacagcgggcggcuggucccccgcggcuccccggggagcggcuacauccccgaggcgccccgggacgggcaggccuacgugcgcaaggacggcgaguggguccugcucuccaccuuccugggcaagcccaucccgaacccccugcucgggcuggacagcaccggc

SEQ ID NO: 13093 - RNA, 1701 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcagaacggccgcauggacuucuucuggaccauccucaagcccaacgacgcgaucaacuucgaguccaacgggaacuucaucgcccccgaguacgccuacaagaucgucaagaagggcgacagcgccaucgucaagagcgagguggaguacggcaacugcaacaccaagugccagaccccgaucggggccaucaacuccagcaugcccuuccacaacauccacccccugacgaucggcgagugccccaaguacgugaaguccaacaagcuggugcucgcgaccgggcugcggaacagcccgcugcgcgagcggcgccggaagcgcggccucuucggcgccaucgccggguucaucgagggcggguggcagggcaugguggacgggugguacggcuaccaccacuccaacgagcagggcagcggguacgccgccgacaaggaguccacccagaaggcgaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgggaggagaucagcggggucaagcuggaguccaucggcacguaccagauccugagcaucuacuccaccguggcgagcucccucgcccuggccaucaugguggccgggcugagccucuggaugugcuccaacggcagccugcagugccgcaucugcauc

SEQ ID NO: 13094 - RNA, 1683 nt, Artificial Sequence; identical to SEQ ID NO: 13092
  derived and/or modified sequence opt1 from anti-influenza_Chain

SEQ ID NO: 13095 - RNA, 1683 nt, Artificial Sequence; identical to SEQ ID NO: 13088
  derived and/or modified sequence opt1 from anti-influenza_Chain

SEQ ID NO: 13096 - RNA, 1683 nt, Artificial Sequence; identical to SEQ ID NO: 13089
  derived and/or modified sequence opt1 from anti-influenza_Chain

SEQ ID NO: 13097 - RNA, 1701 nt, Artificial Sequence; identical to SEQ ID NO: 13093
  derived and/or modified sequence opt1 from anti-influenza_Chain

SEQ ID NO: 13098 - RNA, 1701 nt, Artificial Sequence; identical to SEQ ID NO: 13090
  derived and/or modified sequence opt1 from anti-influenza_Chain

SEQ ID NO: 13099 - RNA, 1701 nt, Artificial Sequence; identical to SEQ ID NO: 13091
  derived and/or modified sequence opt1 from anti-influenza_Chain

SEQ ID NO: 13100 - RNA, 1704 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgacuacgaggccuccagcggcgucuccagcgccugcccguaccagggccgcuccagcuucuuccggaacgugguguggcugaucaagaagaacaacgcguaccccaccaucaagcgcuccuacaacaacacgaaccaggaggaccugcugguccucugggggauccaccaccccaacgacgccgccgagcagauccggcuguaccagaacccgaccaccuacaucagcaucggcaccuccacgcugaaccagcgccucgugcccaagaucgccacccggagcaaggugaacgggcaguccggccgcauggaguucuucuggaccauccucaagagcaacgacgcgaucaacuucgagagcaacgggaacuucaucgcccccgaguacgccuacaagaucgucaagaagggcgacuccaccaucaugaaguccgagcuggaguacggcaacugcaacacgaagugccagacccccaucggggccaucaacagcagcaugccguuccacaacauccacccccugaccaucggcgagugccccaaguacgugaaguccaaccggcuggugcuggccaccgggcuccgcaacagcccccagggcgagcggcgccggcgcaagcggggccuguucggggcgaucgccggcuucaucgagggcggguggcaggggauggucgacggcugguacggcuaccaccacuccaacgagcaggggagcggcuacgccgccgacaaggaguccacgcagaaggccaucgacggggugaccaacaaggugaacagcaucaucaacaagaugaacacccaguucgaggcggucggccgcgaguucaacaaccuggagcggcgcaucgagaaccucaacaagaagauggaggacggguuccuggacguguggaccuacaacgccgagcugcucgugcugauggagaacgagcggacgcuggacuuccacgacuccaacgucaagaaccucuacgacaaggugcgccugcagcugcgggacaacgccaaggagcucggcaacggcugcuucgaguucuaccaccgcugcgacaacgagugcauggagagcguccgcaacgggaccuacgacuacccgcaguacuccgaggaggcccggcugaagcgcgaggagaucagcggcgugaagcuggaguccauggggaucuaccagauccucagcaucuacuccaccguggccagcucccuggcgcuggccaucauggucgccggccucuuccuguggaugugcagcaacgggagccugcagugccggaucugcauc

SEQ ID NO: 13101 - RNA, 1704 nt, Artificial Sequence
  derived and/or modified sequence opt1 from anti-influenza_Chain
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacagcccccagcgggagagccgccggaagaagcgcggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucagcggggucaagcuggaguccaucggcacguaccagauccucagcaucuacuccaccguggccagcagccuggcgcuggccaucaugauggccgggcucucccuguggaugugcagcaacggcucccugcagugccgcaucugcauc

SEQ ID NO: 13102 - RNA, 1704 nt, Artificial Sequence
  derived and/or modified sequence opt1 from anti-influenza_Chain
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcauc

SEQ ID NO: 13103 - RNA, 1704 nt, Artificial Sequence; identical to SEQ ID NO: 13100
  derived and/or modified sequence opt1 from anti-influenza_Chain

SEQ ID NO: 13104 - RNA, 1704 nt, Artificial Sequence; identical to SEQ ID NO: 13101
  derived and/or modified sequence opt1 from anti-influenza_Chain

SEQ ID NO: 13105 - RNA, 1704 nt, Artificial Sequence; identical to SEQ ID NO: 13102
  derived and/or modified sequence opt1 from anti-influenza_Chain

SEQ ID NO: 13106 - RNA, 1707 nt, Artificial Sequence
  derived and/or modified sequence opt1 from anti-influenza_Chain
agcaagucccgcggcuacaagaugaacacccagauccugguguucgcccucgucgccagcauccccaccaacgcggacaagaucugccuggggcaccacgccguguccaacggcacgaaggugaacacccugaccgagcgcggggucgagguggugaacgccaccgagacggucgagcggaccaacgugccgcggaucugcagcaagggcaagcgcaccguggaccucgggcagugcggccugcugggcaccaucacggggccgccccagugcgaccaguuccucgaguucuccgccgaccugaucaucgagcggcgcgagggcagcgacgucugcuaccccgggaaguucgugaacgaggaggcccugcggcagauccuccgcgaguccggcgggaucgacaaggagaccaugggcuucaccuacagcggcauccggaccaacgggacgaccuccgcgugccgccggagcggcuccagcuucuacgccgagaugaaguggcugcuguccaacaccgacaacgccgccuucccgcagaugaccaagagcuacaagaacacgcgcaaggaccccgcgcucaucaucugggggauccaccacuccggcagcaccaccgagcagaccaagcuguacggcuccgggaacaagcugaucacggugggcagcuccaacuaccagcagagcuucguccccagccccggggcccggccccaggugaacggccaguccgggcgcaucgacuuccacuggcucauccugaaccccaacgacaccgugaccuucagcuucaacggcgccuucaucgcccccgaccgggccuccuuccugcgcggcaagagcauggggauccaguccgagguccagguggacgcgaacugcgagggcgacugcuaccacagcgggggcaccaucaucuccaaccuccccuuccagaacaucaacagccgggccguggggaagugcccgcgcuacgucaagcaggagucccugcugcucgccacgggcaugaagaacgugcccgagauccccaagcggcgccggcgcggccuguucggggccaucgccggcuucaucgagaacgggugggagggccugaucgacgggugguacggcuuccgccaccagaacgcgcagggcgaggggaccgccgccgacuacaagagcacccaguccgccaucgaccagaucaccggcaagcucaaccggcugaucgagaagacgaaccagcaguucgagcugaucgacaacgaguucaccgagguggagcgccagaucgggaacgucaucaacuggacccgggacagcaugaccgaggugugguccuacaacgccgagcuccugguggcgauggagaaccagcacacgaucgaccuggccgacagcgagaugaacaagcucuacgagcgcgucaagcggcagcugcgcgagaacgccgaggaggacggcaccggcugcuucgagaucuuccacaagugcgacgacgacugcauggccuccauccggaacaacaccuacgaccacagcaaguaccgcgaggaggccauccagaaccggauccagaucgaccccgugaagcuguccagcggguacaaggacgucauccucugguucuccuucggcgcgagcugcuucauccugcuggccaucgccauggggcucguguucaucugcgugaagaacggcaacaugcgcugcaccaucugcauc

SEQ ID NO: 13107 - RNA, 1707 nt, Artificial Sequence; identical to SEQ ID NO: 13106
  derived and/or modified sequence opt1 from anti-influenza_Chain

SEQ ID NO: 13108 - RNA, 1692 nt, Artificial Sequence
  derived and/or modified sequence opt1 from anti-influenza_Chain
gaccagaucugcaucggcuaccacgccaacaacagcaccgagaagguggacaccaaccuggagcgcaacgucacggugacccacgccaaggacauccucgagaagacccacaacgggaagcugugcaagcugaacggcaucccgccccucgagcugggggacugcuccaucgccggcuggcugcucgggaaccccgagugcgaccggcugcugagcgugcccgagugguccuacaucauggagaaggagaacccccgcgacggccucugcuacccgggcagcuucaacgacuacgaggagcugaagcaccuccuguccagcgucaagcacuucgagaaggugaagauccugcccaaggaccgguggacccagcacacgaccaccgggggcucccgcgccugcgccgugagcgggaaccccuccuucuuccggaacauggucuggcugaccaaggagggcagcgacuaccccguggccaagggguccuacaacaacacgagcggcgagcagaugcucaucaucuggggcgugcaccacccgaucgacgagaccgagcagcgcacccuguaccagaacgucgggaccuacguguccgugggcacgagcacccugaacaagcgguccacccccgagaucgccacccgccccaaggucaacgggcagggcggccggauggaguucagcuggacgcuccuggacaugugggacaccaucaacuucgaguccaccgggaaccugaucgcgcccgaguacggcuucaagaucagcaagcgcggguccagcggcaucaugaagaccgaggggacgcucgagaacugcgagaccaagugccagaccccgcugggcgccaucaacaccacgcugcccuuccacaacgugcacccccucaccaucggcgagugccccaaguacgucaagagcgagaagcuggugcuggccaccgggcuccggaacgugccgcagaucgagucccgcggccuguucggggccaucgcgggcuucaucgagggcggguggcagggcaugguggacgggugguacggcuaccaccacagcaacgaccagggguccggcuacgccgccgacaaggagagcacccagaaggccuucgacgggaucacgaacaaggucaacuccgugaucgagaagaugaacacccaguucgaggccgugggcaaggaguucggcaaccuggagcggcgccucgagaaccugaacaagcggauggaggacggguuccuggacgucuggaccuacaacgcggagcuccuggugcugauggagaacgagcgcacccucgacuuccacgacagcaacgugaagaaccuguacgacaagguccggaugcagcugcgcgacaacgugaaggagcucggcaacgggugcuucgaguucuaccacaagugcgacgacgagugcaugaacuccgucaagaacggcacguacgacuaccccaaguacgaggaggagagcaagcugaaccggaacgagaucaagggcgugaagcuguccagcauggggguguaccaguccggccgccucgucccccgggggagccccggcuccggguacaucccggaggcgccccgcgacggccaggccuacgugcgcaaggacggcgagugggugcugcugagcaccuuccucgggaagcccauccccaacccgcugcugggccucgacuccaccggg

SEQ ID NO: 13109 - RNA, 1692 nt, Artificial Sequence
  derived and/or modified sequence opt1 from anti-influenza_Chain
cagaagcugcccggcaacgacaacagcaccgccacccucugccuggggcaccacgccgugccgaacggcacgaucgucaagaccaucaccaacgaccagaucgaggugaccaacgcgacggagcuggugcaguccagcuccaccgggggcaucugcgacagcccccaccagauccucgacggggagaacugcacccugaucgacgcccugcucggcgacccccagugcgacggcuuccagaacaagaagugggaccuguucgucgagcgcuccaaggccuacagcaacugcuaccccuacgacgugccggacuacgccucccugcggagccucguggccuccagcgggacccuggaguucaacgacgaguccuucaacuggacgggcgucacccagaacgggaccagcuccagcugcaagcgccgguccaacaacagcuucuucucccgccugaacuggcucacccagcugaaguucaaguaccccgcgcugaacgugacgaugcccaacaacgagaaguucgacaagcucuacaucuggggcgugcaccaccccgucaccgacaacgaccagaucuuccuguacgcccaggccagcgggcggaucaccguguccaccaagcgcagccagcagacggugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggaucggccaggcggccgaccugaaguccacgcaggccgccaucaaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucacggacagcgagaugaacaagcuguucgagcggaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcucaagagcggcuccggccggcuggugccccgcgggagcccgggcuccggguacauccccgaggcgccccgggacggccaggccuacgugcgcaaggacggcgaguggguccugcugagcaccuuccuggggaagcccaucccgaacccccuccugggccuggacagcacgggg

SEQ ID NO: 13110 - RNA, 1692 nt, Artificial Sequence; identical to SEQ ID NO: 13108
  derived and/or modified sequence opt1 from anti-influenza_Chain

SEQ ID NO: 13111 - RNA, 1692 nt, Artificial Sequence; identical to SEQ ID NO: 13109
  derived and/or modified sequence opt1 from anti-influenza_Chain

SEQ ID NO: 13112 - RNA, 1695 nt, Artificial Sequence
  derived and/or modified sequence opt1 from anti-influenza_Chain
gacaccaucugcaucggcuaccacgccaacaacagcaccgacacgguggacaccguccuggagaagaacgugaccgugacccacuccgucaaccuccuggaggacagccacaacgggaagcugugccuccugaagggcaucgcgccccugcagcucgggaacugcuccguggccggcuggauccuggggaacccggagugcgagcugcucaucagccgcgaguccuggagcuacaucguggagaagcccaaccccgagaacggcacgugcuaccccggccacuucgccgacuacgaggagcugcgggagcagcuguccagcgucuccagcuucgagcgcuucgagaucuucccgaaggaguccagcuggcccaaccacaccaccaccgggguguccgccagcugcucccacaacggcgagagcuccuucuacaagaaccuccuguggcugacggggaagaacggccucuaccccaaccugagcaaguccuacgccaacaacaaggagaaggaggugcugguccucuggggcgugcaccacccgcccaacaucggggaccagcgggcccuguaccacaaggagaacgcguacgugagcgucgugagcucccacuacagccgcaaguucacccccgagaucgccaagcggcccaaggugcgcgaccaggagggccggaucaacuacuacuggacccugcucgagcccggggacaccaucaucuucgaggccaacggcaaccugaucgccccgcgcuacgcguucgcccugucccggggguucggcagcggcaucaucaacuccaacgcccccauggacgagugcgacgccaagugccagacgccccagggggccaucaacagcucccuccccuuccagaacguccacccggugaccaucggcgagugccccaaguacgugcgcagcgcgaagcugcggauggucaccgggcugcgcaacauccccuccauccagagccggggccucuucggggccaucgccggcuucaucgagggcggguggaccggcaugguggacgggugguacggcuaccaccaccagaacgagcagggguccggcuacgccgccgaccagaaguccacgcagaacgcgaucaacggcaucaccaacaaggugaacagcgucaucgagaagaugaacacccaguucaccgccguggggaaggaguucaacaagcuggagcgccggauggagaaccugaacaagaagguggacgacggcuucaucgacaucuggacguacaacgccgagcuccugguccugcucgagaacgagcgcacccuggacuuccacgacagcaacgugaagaaccuguacgagaaggucaagucccagcucaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcuggaguccaugggcgucuaccagagcgggcgccucgugccgcggggcagccccggguccggcuacauccccgaggcgccccgcgacggccaggccuacgugcggaaggacggggaguggguccugcugagcaccuuccucggcaagccgauccccaacccccugcuggggcucgacuccacgggc

SEQ ID NO: 13113 - RNA, 1695 nt, Artificial Sequence
  derived and/or modified sequence opt1 from anti-influenza_Chain
cagaacuacaccggcaaccccgugaucugccuggggcaccacgccgucagcaacggcaccauggugaagacgcucaccgacgaccagaucgagguggucaccgcccaggagcugguggagucccagcaccucccggagcugugccccagcccccugcgccugguggacgggcagaccugcgacaucgucaacggcgcgcucgggucccccggcugcgaccaccugaacggcgccgagugggacguguucaucgagcggccgacggccguggacacgugcuaccccuucgacguccccgacuaccagagccugcgcuccauccucgccaacaacgggaaguucgaguucaucgccgaggaguuccaguggaacaccgugaagcagaacggcaagagcggggcgugcaagcgggccaacgugaacgacuucuucaaccgccugaacuggcugaccaaguccgacggcaacgccuacccccuccagaaccugaccaaggucaacaacggggacuacgcccggcuguacaucuggggcgugcaccacccgagcaccgacaccgagcagaccaaccucuacaagaacaaccccggccgcgugacggucuccacccagaccagccagaccuccguggugcccaacaucgggagccggcccuggguccgcggccuguccagccggaucuccuucuacuggacgaucguggagccgggggaccugaucguguucaacaccaucggcaaccucaucgcgccccgcggccacuacaagcugaacagccagaagaaguccaccauccugaacaccgccguccccaucgggagcugcguguccaagugccacacggacaagggcagcaucagcaccaccaagcccuuccagaacaucucccggaucagcaucggggacugcccgaaguacgugaagcagggcucccucaagcuggccaccgggaugcgcagcauccuggagaaggccacgcggggccucuucggcgccaucgcgggguucaucgagaacggcuggcaggggcugaucgacggcugguacggguuccgccaccagaacgccgagggcaccggcaccgccgccgaccugaaguccacccaggccgcgaucgaccagaucaacgggaagcucaaccggcugaucggcaagcccaacgagaaguaccaccagaucgagaaggaguucgagcaggucgaggggcgcauccaggaccuggagaaguacguggaggacacgaagaucgaccucuggagcuacaacgccgagcugcuggucgcccucgagaaccagcacaccaucgacgugaccgacuccgagaugaacaagcuguucgagcgggugcgccaccagcugcgggagaacgccgaggacaagggcaacgggugcuucgagaucuuccaccagugcgacaacagcugcaucgaguccauccgcaacggcaccuacgaccacgacaucuaccgggacgaggccaucaacaaccgcuuccagauccagggcgucaagcucauccagggguacaaggacagcggccgccuggugccccgggggucccccggcagcggcuacaucccggaggcgccccgcgacgggcaggccuacgugcggaaggacggcgaguggguccugcucuccacguuccuggggaagcccauccccaacccgcugcucggccuggacagcaccggg

SEQ ID NO: 13114 - RNA, 1695 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcaaccuggacggcgugaagccccugauccucaaggacugcuccgucgccggguggcugcugggcaacccgaugugcgacgaguuccucaacgugagcgagugguccuacaucguggagaaggccagccccgccaacgggcugugcuaccccggcgacuucaacgacuacgaggagcugaagcaccuccugucccgcaucaaccaccugaagaagaucaagaucauccccaagagcuacugguccaaccacgaggccagcuccggcgucagcgccgcgugcuccuaccucggggagccgagcuucuuccggaacgugguguggcugaucaagaagaacaacaccuacccgcccaucaaggucaacuacacgaacaccaaccaggaggaccugcucgugcuguggggcauccaccaccccaacgacgagaaggagcagauccgcaucuaccagaaccccaacaccuccaucagcguggggaccuccacgcugaaccagcggcucguccccaagaucgccacccgccccaaggugaacggccagagcgggcggauggaguucuucuggaccauccugaagcccaacgacuccaucaacuucgacagcaacggcaacuucaucgccccggaguacgccuacaagaucgcgaagaagggcgacuccgugaucaugaaguccgagcuggaguacgggaacugcaacaccaagugccagacgcccaugggcgccaucaacagcagcaugcccuuccacaacauccacccccucaccaucggggagugcccgaaguacgucaagagcaaccgccuggugcuggccaccggccuccggaacgcgccccagaccgagacgcgcggccuguucggggccaucgccggcuucaucgagggcggguggcaggggaugguggacggcugguacggcuaccaccacuccaacgagcaggggagcggcuacgccgccgacaaggaguccacccagaaggccaucgacgggaucaccaacaaggucaacagcaucaucgacaagaugaacacccaguucgagaucgugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgagaaggugcggcugcagcugcgcgacaacgcgaaggagcucggcaacggcugcuucgaguucuaccacaagugcgacaacgagugcauggagagcguccggaacgggaccuacgacuacccccaguacuccgaggaggcccgccugagccgggaggagaucuccggcgugaagauggagagcauggucaccuaccaguccgggcgccuggugccccggggcagcccgggguccggcuacauccccgaggcgccccgcgacggccaggccuacgugcggaaggacggggaguggguccuccugagcacguuccugggcaagcccaucccgaacccccuccuggggcuggacuccaccggc

SEQ ID NO: 13115 - RNA, 1695 nt, Artificial Sequence; identical to SEQ ID NO: 13112
  derived and/or modified sequence opt1 from anti-influenza_Chain

SEQ ID NO: 13116 - RNA, 1695 nt, Artificial Sequence; identical to SEQ ID NO: 13113
  derived and/or modified sequence opt1 from anti-influenza_Chain

SEQ ID NO: 13117 - RNA, 1695 nt, Artificial Sequence; identical to SEQ ID NO: 13114
  derived and/or modified sequence opt1 from anti-influenza_Chain

SEQ ID NO: 13118 - RNA, 1698 nt, Artificial Sequence
  derived and/or modified sequence opt1 from anti-influenza_Chain
gacacccugugcaucggcuaccacgccaacaacagcaccgacacgguggacaccguccucgagaagaacgugaccgugacccacuccgucaaccugcuggaggacaagcacaacgggaagcucugcaagcugcgcggcguggcgccccugcaccucgggaagugcaacaucgcgggcuggauccuggggaacccggagugcgagagccuguccacggccagcuccuggagcuacaucguggagacccccuccagcgacaacgggaccugcuaccccggcgacuucaucgacuacgaggagcuccgggagcagcuguccagcgucuccagcuucgagcgcuucgagaucuuccccaagaccuccagcuggccgaaccacgacuccaacaagggcgugacggccgccugcccccacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgccgaccagcagucccuguaccagaacgccgacaccuacguguucgucggcagcucccgguacagcaagaaguucaagccggagaucgccauccgccccaaggugcgggaccaggagggccgcaugaacuacuacuggacccugguggagcccggggacaagaucacguucgaggcgaccggcaaccucgucgugccccgguacgccuucgccauggagcgcaacgccggguccggcaucaucaucagcgacaccccggugcacgacugcaacaccacgugccagacccccaagggcgccaucaacaccucccugcccuuccagaacauccaccccaucaccaucgggaagugcccgaaguacgucaagagcacgaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccaguccgggcggcuggucccccgcggcagcccgggcagcggguacauccccgaggcgccccgggacggccaggccuacgugcgcaaggacggggagugggugcugcucuccaccuuccugggcaagcccaucccgaacccccugcucggccuggacagcaccggg

SEQ ID NO: 13119 - RNA, 1698 nt, Artificial Sequence
  derived and/or modified sequence opt1 from anti-influenza_Chain
gaccgcaucugcaucggcuaccagagcaacaacuccaccgacaccgugaacacgcugaucgagcagaagguccccgugacccagaccauggagcucguggagaccgagaagcacccggccuacugcaacacggaccugggggcgccccuggagcuccgggacugcaagaucgaggccgucaucuacggcaaccccaagugcgacauccaccugaaggaccagggguggagcuacaucguggagcgccccuccgccccggagggcaugugcuaccccgggagcguggagaaccuggaggagcuccgguucgucuucuccagcgccgccuccuacaagcgcauccggcuguucgacuacagccgcuggaacgugaccuccagcggcaccuccaaggccugcaacgcgagcaccggcgggcaguccuucuaccggagcaucaacuggcugacgaagaagaagcccgacaccuacgacuucaacgagggcaccuacgugaacaacgaggacggggacaucaucuuccucuggggcauccaccacccgcccgacaccaaggagcagacgacccuguacaagaacgccaacacccuguccagcgucaccacgaacaccaucaaccgcuccuuccagcccaacaucgggccccggccccucgugcgcggccagcagggccggauggacuacuacugggggauccugaagcgcggcgagacccugaagauccggaccaacgggaaccucaucgccccggaguucggcuaccugcugaagggcgagagccacgggcgcacgauccagaacgaggacauccccaucggcaacugcuacaccaagugccagaccuacgccggggcgaucaacuccagcaagcccuuccagaacgccagccggcacuacaugggcgagugccccaaguacgugaagaaggccucccuccgccuggccgucgggcugcggaacaccccgagcguggagccccgcggccucuucggcgccaucgcgggguucaucgagggcgggugguccggcaugaucgacgggugguacggcuuccaccacagcaacuccgagggcacggggauggccgccgaccagaaguccacccaggaggccaucgacaagaucaccaacaaggugaacaacaucgucgacaagaugaaccgggaguucgagguggugaaccacgaguucagcgaggucgagaagcgcaucaacaugaucaacgacaagaucgacgaccagaucgaggaccugugggccuacaacgcggagcugcucgugcugcuggagaaccagaagacccucgacgagcacgacagcaacgugaagaaccuguucgacgaggucaagcggcgccuguccgccaacgccaucgacgccggcaacgggugcuucgacauccuccacaagugcgacaacgagugcauggagacgaucaagaacggcaccuacgaccacaaggaguacgaggaggaggccaagcuggagcgcagcaagaucaacggggugaagcuggaggagaacaccaccuacaaguccggccggcucgugccccgcggcagccccggguccggcuacaucccggaggcgccccgggacgggcaggccuacguccgcaaggacggcgagugggugcugcugagcacguuccucggcaagcccauccccaacccgcugcuggggcucgacuccaccggc

SEQ ID NO: 13120 - RNA, 1698 nt, Artificial Sequence; identical to SEQ ID NO: 13118
  derived and/or modified sequence opt1 from anti-influenza_Chain

SEQ ID NO: 13121 - RNA, 1698 nt, Artificial Sequence; identical to SEQ ID NO: 13119
  derived and/or modified sequence opt1 from anti-influenza_Chain

SEQ ID NO: 13122 - RNA, 1701 nt, Artificial Sequence
  derived and/or modified sequence opt1 from anti-influenza_Chain
gacaagaucugcaucggcuaccacgccaacaacagcaccacccagguggacacgauccuggagaagaacgucaccgugacccacuccguggagcuccuggagaaccagaaggaggagcgcuucugcaagauccugaacaaggcgccccucgaccugcgggggugcaccaucgagggcuggauccuggggaacccgcagugcgaccuccugcugggcgaccagagcugguccuacaucgucgagcgccccacggcccagaacgggaucugcuaccccggcgcccucaacgagguggaggagcugaaggcccugaucggcagcggggagcggguggagcgcuucgagauguuccccaaguccaccuggaccggcgucgacaccagcuccggggugacgaaggccugcccguacaacagcggcuccagcuucuaccggaaccuccuguggaucaucaagaccaaguccgccgccuaccccgugaucaaggggaccuacaacaacaccggcagccagcccauccuguacuucuggggcguccaccacccgcccgacacgaacgagcagaacacccucuacggguccggcgaccgcuacgugcggauggggaccgagagcaugaacuucgccaagucccccgagaucgccgcccgccccgcggugaacggccagcggggccgcaucgacuacuacuggagcguccugaagcccggggagacccugaacguggaguccaacggcaaccucaucgccccgugguacgccuacaaguucgugagcacgaacaacaagggggccaucuucaaguccaaccugcccaucgagaacugcgacgcgaccugccagaccaucgccggcguccugcggaccaacaagacguuccagaacgugagcccccucuggaucggggagugccccaaguacgucaagagcgagucccugcgccuggccaccggccuccggaacgugccgcagaucgagacccgcggccuguucggggccaucgccggcuucaucgagggcggguggaccgggaugaucgacggcugguacggcuaccaccacgagaacagccagggguccggcuacgccgcggacaaggagagcacgcagaaggccaucgacgggaucaccaacaaggugaacuccaucaucgacaagaugaacacccaguucgaggccguggaccacgaguucagcaaccuggagcggcgcaucgacaaccucaacaagcggauggaggacggcuuccuggacgucuggaccuacaacgccgagcugcucgugcugcuggagaacgagcgcacgcucgaccugcacgacgccaacgugaagaaccuguacgagaaggucaagucccagcuccgggacaacgcgaacgaccuggggaacggcugcuucgaguucuggcacaagugcgacaacgagugcaucgagagcgugaagaacggcaccuacgacuaccccaaguaccaggacgaguccaagcugaaccgccaggagaucgagagcgucaagcucgacaaccuggggguguaccaguccggccggcuggugccccgcgggagccccggcuccggcuacaucccggaggcgccccgcgacgggcaggccuacguccggaaggacggcgagugggugcuccugagcaccuuccuggggaagcccauccccaacccgcuccugggccuggacuccaccggg

SEQ ID NO: 13123 - RNA, 1701 nt, Artificial Sequence; identical to SEQ ID NO: 13122
  derived and/or modified sequence opt1 from anti-influenza_Chain

SEQ ID NO: 13124 - RNA, 1704 nt, Artificial Sequence
  derived and/or modified sequence opt1 from anti-influenza_Chain
gaccacaucugcaucggcuaccacgccaacaacagcaccgagcaggucgacaccaucauggagaagaacgugacggugacccacgcccaggacauccuggagaagacccacaacgggaagcucugcgaccugaacggcgugaagccccugauccucaaggacugcuccgucgccggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccgcaucaaccacuucgagaagauccagaucaucccgaaggacagcugguccgaccacgaggccagccugggcgucuccagcgccugccccuaccagggcaacuccagcuucuuccggaacgugguguggcugaucaagaaggggaacgcguaccccaccaucaagaaguccuacaacaacacgaaccaggaggaccuccugguccuguggggcauccaccaccccaacgacgaggccgagcagacccgccucuaccagaacccgaccaccuacaucagcaucgggacguccacccugaaccagcggcuggugcccaagaucgccacccgcagcaaggugaacggccaguccgggcggaucgacuucuucuggaccauccucaagcccaacgacgccaucaacuucgagagcaacggcaacuucaucgcgcccgaguacgccuacaagaucgucaagaagggcgacuccacgaucaugaaguccgagguggaguacgggaacugcaacacccgcugccagaccccgaugggcgccaucaacagcagcaugcccuuccacaacauccacccccugaccaucggggagugccccaaguacgucaagagcaacaagcuggugcucgccacgggccugcggaacuccccgcagcgcgagcggcgccggaagcgcggccuguucggggccaucgcgggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacccaguucgaggccgugggccgggaguucaacaaccucgagcgccggaucgagaaccugaacaagaagauggaggacggguuccuggacguguggacguacaacgcggagcuccugguccugauggagaacgagcgcacccucgacuuccacgacagcaacgugaagaaccuguacgacaaggugcggcugcagcuccgcgacaacgccaaggagcugggcaacggcugcuucgaguucuaccacaagugcgacaacgagugcauggaguccguccggaacgggaccuacgacuacccccaguacagcgaggaggcccgccugaagcgggaggagaucuccggcgugaagcucgagagcaucgggaccuaccaguccggccgccuggucccccgcgggagccccggcuccggcuacaucccggaggcgccccgggacgggcaggccuacgugcgcaaggacggcgagugggugcugcucagcacguuccuggggaagcccauccccaacccgcugcucggccuggacuccaccggc

SEQ ID NO: 13125 - RNA, 1704 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugccccuaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcaguccggccgcauggacuucuucuggaccauccugaagcccaacgacgccaucaacuucgagagcaacgggaacuucaucgcgcccgaguacgccuacaagaucgucaagaagggcgacuccgccaucgugaaguccgagguggaguacggcaacugcaacaccaagugccagaccccgaucggggccaucaacagcagcaugcccuuccacaacauccacccccucacgaucggcgagugccccaaguacgucaagagcaacaagcuggugcuggccaccgggcuccggaacuccccgcugcgcgagcggcgccggaagcgcggccuguucggcgcgaucgccggguucaucgagggcggguggcagggcaugguggacgggugguacggcuaccaccacagcaacgagcagggcuccggguacgccgccgacaaggagagcacccagaaggccaucgacggcgucaccaacaaggugaacuccaucaucgacaagaugaacacgcaguucgaggcgguggggcgggaguucaacaaccucgagcgccggaucgagaaccugaacaagaagauggaggacggcuuccuggacgucuggaccuacaacgccgagcuccuggugcugauggagaacgagcgcacccucgacuuccacgacagcaacgugaagaaccuguacgacaagguccggcugcagcuccgcgacaacgccaaggagcuggggaacggcugcuucgaguucuaccacaagugcgacaacgagugcauggaguccgugcggaacggcaccuacgacuacccccaguacagcgaggaggcccgccugaagcgggaggagaucuccggggucaagcucgagagcaucggcacguaccaguccgggcgccuggugccccgcggcagccccggguccggcuacaucccggaggccccgcgggacggccaggcguacgugcgcaaggacggggaguggguccugcucagcaccuuccugggcaagcccauccccaacccgcugcucgggcuggacuccaccggc

SEQ ID NO: 13126 - RNA, 1704 nt, Artificial Sequence; identical to SEQ ID NO: 13124
  derived and/or modified sequence opt1 from anti-influenza_Chain

SEQ ID NO: 13127 - RNA, 1704 nt, Artificial Sequence; identical to SEQ ID NO: 13125
  derived and/or modified sequence opt1 from anti-influenza_Chain

SEQ ID NO: 13128 - RNA, 1707 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagaagcacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccugucccggaucaaccacuucgagaagauccagaucauccccaagagcuccuggagcucccacgaggccagccugggcguguccagcgccugccccuaccagggcaaguccagcuucuuccgcaacguggucuggcugaucaagaagaacuccaccuaccccaccaucaagcggagcuacaacaacacgaaccaggaggaccuccuggugcugugggggauccaccaccccaacgacgccgcggagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgaguccaacgggaacuucaucgcccccgaguacgcguacaagaucgugaagaagggcgacagcacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacagcccgcagcgcgagcggcgccggaagaagcgcggccucuucggcgccaucgccggguucaucgagggcggguggcagggcaugguggacgggugguacggcuaccaccacuccaacgagcagggcagcggguacgcggccgacaaggaguccacccagaaggccaucgacggcgucaccaacaaggugaacagcaucaucgacaagaugaacacccaguucgaggccguggggcgggaguucaacaaccuggagcgccggaucgagaaccugaacaagaagauggaggacggcuuccucgacgucuggacguacaacgccgagcugcuggugcucauggagaacgagcgcacccuggacuuccacgacuccaacgugaagaaccuguacgacaagguccggcuccagcugcgcgacaacgcgaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagagcgggcggcuggugccccgcggcucccccgggagcggcuacaucccggaggccccgcgggacggccaggccuacgugcgcaaggacggggaguggguccuccuguccaccuuccugggcaagcccauccccaacccgcuccuggggcuggacagcacgggc

SEQ ID NO: 13129 - RNA, 1707 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccaccaacgaccucugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcugaucaagaagaacagcacguaccccaccaucaagaaguccuacaacaacaccaaccaggaggaccuccugguccugugggggauccaccacccgaacgacgccgcggagcagacccggcucuaccagaaccccacgaccuacaucagcaucggcaccuccacccugaaccagcgccuggugcccaagaucgccacgcggagcaaggugaacgggcaguccggccgcauggaguucuucuggaccauccucaagcccaacgacgccaucaacuucgagagcaacgggaacuucaucgccccggaguacgcguacaagaucgucaagaagggcgacagcgccaucaugaaguccgagcuggaguacggcaacugcaacaccaagugccagacccccaugggggccaucaacagcuccaugcccuuccacaacauccacccccugacgaucggcgagugcccgaaguacgugaaguccaaccggcucgugcuggccaccgggcugcgcaacagcccccagcgggagagccgccggaagaagcgcggccucuucggcgccaucgcgggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcauccggaacggcaccuacaacuacccccaguacuccgaggaggcccgccucaagcgggaggagaucagcggggugaagcuggaguccaucggcacguaccagagcgggcgccuggucccccgcggcuccccggggagcggcuacauccccgaggcgccccgggacggccaggccuacgugcgcaaggacggggaguggguccuccuguccaccuuccugggcaagcccaucccgaacccccuccuggggcuggacagcaccggc

SEQ ID NO: 13130 - RNA, 1707 nt, Artificial Sequence
  derived and/or modified sequence opt1 from anti-influenza_Chain
gaccagaucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguuccucaacgugagcgagugguccuacaucguggagaagaucaaccccgccaacgaccugugcuaccccgggaacuucaacaacuacgaggagcugaagcaccuccugagccggaucaaccgcuucgagaagauccagaucauccccaaguccagcuggccggaccacgaggccucccugggcgucagcuccgccugccccuaccagggcgggcccagcuucuaccggaacgugguguggcucaucaagaagaacaacaccuaccccacgaucaagaaguccuaccacaacaccaaccaggaggaccugcugguccucuggggcauccaccacccgaacgacgaggccgagcagacccgcaucuacaagaaccccaccacguacaucagcguggggaccuccacccugaaccagcggcuggugcccaagaucgcgacccgcagcaaggucaacggccaguccgggcggguggaguucuucuggacgauccucaagagcaacgacaccaucaacuucgaguccaacggcaacuucaucgcccccgagaacgccuacaagaucgugaagaagggcgacagcaccaucaugaaguccgagcuggaguacgggaacugcaacaccaagugccagacgccgaucggcgccaucaacagcagcaugcccuuccacaacauccacccccugaccaucggggagugccccaaguacgucaaguccaaccgccucgugcuggcgaccggccugcggaacagcccgcagggcgagcgccggcgcaagaagcggggccucuucggggccaucgccggguucaucgagggcggguggcagggcaugguggacggcugguacggguaccaccacuccaacgagcagggcagcggguacgccgccgacaaggaguccacccagaaggcgaucgacggcgucacgaacaaggugaacagcaucaucgacaagaugaacacccaguucgaggccguggggcgcgaguucaacaaccuggagcggcgcaucgagaaccugaacaagaagauggaggacggcuuccucgacgucuggaccuacaacgccgagcugcuggugcucauggagaacgagcggacccuggacuuccacgacuccaacgugaagaaccuguacgacaagguccgccuccagcugcgggacaacgccaaggagcugggcaacgggugcuucgaguucuaccaccgcugcgacaacgagugcauggagagcgugcggaacggcacguacgacuacccccaguacuccgaggaggcccgccucaagcgcgaggagaucagcggggucaagcuggaguccaucggcaccuaccagagcgggcggcuggugccccgcggcucccccggcagcggguacaucccggaggcgccccgggacggccaggccuacgugcgcaaggacggggaguggguccuccuguccaccuuccugggcaagcccauccccaacccgcuccugggccuggacagcaccggg

SEQ ID NO: 13131 - RNA, 1707 nt, Artificial Sequence; identical to SEQ ID NO: 13128
  derived and/or modified sequence opt1 from anti-influenza_Chain

SEQ ID NO: 13132 - RNA, 1707 nt, Artificial Sequence; identical to SEQ ID NO: 13129
  derived and/or modified sequence opt1 from anti-influenza_Chain

SEQ ID NO: 13133 - RNA, 1707 nt, Artificial Sequence; identical to SEQ ID NO: 13130
  derived and/or modified sequence opt1 from anti-influenza_Chain

SEQ ID NO: 13134 - RNA, 1728 nt, Artificial Sequence
  derived and/or modified sequence opt1 from anti-influenza_Chain
aucugcaucggcuaccacgccaacaacagcaccgagcaggucgacaccaucauggagaagaacgugacggugacccacgcccaggacauccuggagaagacccacaacgggaagcucugcgaccuggacggcgugaagccccugauccuccgcgacugcuccgucgcgggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgccugccccuaccagggcacccccuccuucuuccgcaacgugguguggcugaucaagaagaacaacacguaccccaccaucaagcggagcuacaacaacaccaaccaggaggaccugcucauccugugggggauccaccacuccaacgacgcggccgagcagaccaagcuguaccagaacccgacgaccuacaucagcgucggcaccuccacccucaaccagcgccuggugcccaagaucgccacgcggagcaaggugaacgggcagaacggccgcauggacuucuucuggaccauccugaagcccaacgacgccaucaacuucgaguccaacgggaacuucaucgcgcccgaguacgccuacaagaucgucaagaagggcgacagcgccaucgugaaguccgagguggaguacggcaacugcaacaccaagugccagaccccgaucggggccaucaacagcagcaugcccuuccacaacauccacccccucacgaucggcgagugccccaaguacgucaaguccaacaagcuggugcuggccaccgggcuccggaacagcccgcugggcuacauccccgaggcgccccgcgacggccaggccuacgugcggaaggacggggaguggguccugcucuccaccuuccugcgcagcgacaagacccacacgugcccgccgugccccgcccccgagcugcucggcgggcccuccguguuccuguucccgcccaagcccaaggacacccugaugaucagccggacccccgaggugaccugcgucgugguggacgucucccacgaggacccggaggugaaguucaacugguacgucgacggcguggaggugcacaacgccaagacgaagccccgcgaggagcaguacaacagcaccuaccgggucguguccgugcucaccguccugcaccaggacuggcugaacgggaaggaguacaagugcaaggugagcaacaaggcccuccccgcgccgaucgagaagaccaucuccaaggccaagggccagccccgcgagccccagguguacacgcugcccccgagccgggaggagaugaccaagaaccaggucucccugaccugccucgugaagggcuucuaccccagcgacaucgccguggagugggaguccaacgggcagcccgagaacaacuacaagaccacgcccccgguccuggacagcgacggcuccuucuuccuguacagcaagcucaccguggacaagucccgcuggcagcaggggaacguguucagcugcagcgucaugcacgaggcccugcacaaccacuacacccagaagucccugagccucucccccggcaag

SEQ ID NO: 13135 - RNA, 1728 nt, Artificial Sequence
  derived and/or modified sequence opt1 from anti-influenza_Chain
augguggucaccagcaacgccgaccgcaucugcaccggcaucacguccagcaacagcccccacguggugaagaccgccacccagggggaggucaacgugaccggcgugaucccgcugacgaccacccccaccaagagccacuucgcgaaccucaaggggacggagacccggggcaagcugugccccaagugccugaacugcaccgaccucgacgucgcccuggggcgccccaagugcaccggcaacaucccguccgcccgggugagcauccugcacgaggugcgccccgucacguccggcugcuuccccaucaugcacgaccggaccaagauccgccagcuccccaaccugcugcggggguacgagcacauccgccucagcacccacaacgugaucaacgccgagaacgccccgggcgggcccuacaagaucggcaccuccgggagcugccccaacgugacgaacggcaacggcuucuucgcgaccauggccugggccguccccaagaacgacaacaacaagaccgccaccaacucccugacgaucgaggugccguacaucugcaccgagggggaggaccagaucaccguguggggcuuccacagcgacaacgagacccagauggcgaagcuguacggggacuccaagccccagaaguucacgagcuccgccaacggcgucaccacccacuacgugagccagaucggcggguuccccaaccagaccgaggacggcgggcucccccaguccggccggaucguggucgacuacauggugcagaaguccgggaagacgggcaccaucaccuaccagcgcggcauccugcugccgcagaagguguggugcgccuccggcaagagcaaggucaucaaggggagccucccccugaucggggaggccgacugccugcacgagaaguacggcgggcucaacaaguccaagcccuacuacaccggcgagcacgccaaggcgaucggcaacugccccaucugggugaagacgccgcugaagcuggccaacgggaccaaguaccggccgcccgccaagcuccugaaggagcgcggcuucuucggggccaucgccggcuuccuggagggcgggugggagggcaugaucgcgggguggcacggcuacaccagccacggggcccacggcguggccgucgccgccgaccucaaguccacccaggaggcgaucaacaagaucacgaagaaccugaacagccuguccgagcucgaggugaagaaccugcagcggcugagcggcgccauggacgagcuccacaacgagauccuggagcuggacgagaaggucgacgaccuccgcgccgacaccaucuccagccagaucgagcuggccgugcugcucuccaacgaggggaucaucaacagcgaggacgagcaccuccuggcccuggagcggaagcugaagaagaugcugggccccuccgcgguggagaucgggaacggcugcuucgagaccaagcacaagugcaaccagaccugccucgaccgcaucgccgccgggaccuucgacgccggcgaguucagccugcccacguucgacucccugaacaucaccgcggccagccucaacgacgacggccuggacaaccacaccauccugcucuacuacuccaccgccgccagcucccuggccgucacgcugaugaucgcgaucuucgugguguacauggucagccgggacaacguguccugcuuccacagc

SEQ ID NO: 13136 - RNA, 1728 nt, Artificial Sequence; identical to SEQ ID NO: 13135
  derived and/or modified sequence opt1 from anti-influenza_Chain

SEQ ID NO: 13137 - RNA, 1728 nt, Artificial Sequence; identical to SEQ ID NO: 13134
  derived and/or modified sequence opt1 from anti-influenza_Chain

SEQ ID NO: 13138 - RNA, 1731 nt, Artificial Sequence
  derived and/or modified sequence opt1 from anti-influenza_Chain
gccaaggccggcgugcagagcgucaagauggagaagaucgugcugcuguucgcgaucgugucccuggucaagagcgaccagaucugcaucggguaccacgccaacaacuccaccgagcaggucgacaccaucauggagaagaacgugacggugacccacgcccaggacauccuggagaagacccacaacggcaagcucugcgaccuggacggggugaagccccugauccuccgcgacugcagcguggccggcuggcugcuggggaacccgaugugcgacgaguucaucaacguccccgagugguccuacaucguggagaaggccaaccccgugaacgaccucugcuaccccggcgacuucaacgacuacgaggagcugaagcaccuccucagccggaucaaccacuucgagaagauccagaucaucccgaaguccagcugguccagccacgaggcgucccugggcgucagcuccgccugccccuaccagggcaagagcuccuucuuccgcaacgugguguggcugaucaagaagaacagcaccuaccccacgaucaagcgguccuacaacaacaccaaccaggaggaccuccugguccugugggggauccaccaccccaacgacgccgccgagcagaccaagcucuaccagaacccgaccacguacaucagcguggggaccuccacccugaaccagcgccuggugccccggaucgcgacccgcagcaaggucaacggccagagcgggcggauggaguucuucuggacgauccucaagcccaacgacgccaucaacuucgaguccaacggcaacuucaucgcccccgaguacgccuacaagaucgugaagaagggcgacagcaccaucaugaaguccgagcuggaguacgggaacugcaacaccaagugccagaccccgaugggcgccaucaacagcuccaugcccuuccacaacauccacccccugacgaucggggagugccccaaguacgucaagagcaaccgccucgugcuggcgaccggccugcggaacuccccgcagcgcgagcggcgccggaagaagcgcggccucuucggggccaucgccggcuucaucgagggcggguggcaggggaugguggacggcugguacggcuaccaccacagcaacgagcagggguccggcuacgccgccgacaaggagagcacccagaaggcgaucgacggggugaccaacaaggucaacuccaucaucgacaagaugaacacgcaguucgaggccgugggccgggaguucaacaaccuggagcgccggaucgagaaccugaacaagaagauggaggacggguuccucgacgucuggaccuacaacgccgagcugcuggugcucauggagaacgagcgcacccuggacuuccacgacagcaacgugaagaaccuguacgacaagguccggcuccagcugcgcgacaacgccaaggagcugggcaacggcugcuucgaguucuaccacaagugcgacaacgagugcauggaguccgugcggaacgggaccuacgacuacccccaguacagcgaggaggcccgccucaagcgcgaggagaucuccggcgugaagcuggagagcaucgggaucuaccagauccuguccaucuacagcacggucgcguccagccucgcccuggcccugaugguggccggccucagccuguggaugugcuccaacgggagccugcagugccggaucugcauc

SEQ ID NO: 13139 - RNA, 1731 nt, Artificial Sequence; identical to SEQ ID NO: 13138
  derived and/or modified sequence opt1 from anti-influenza_Chain

SEQ ID NO: 13140 - RNA, 1737 nt, Artificial Sequence
  derived and/or modified sequence opt1 from anti-influenza_Chain
augguggucaccagcaacgccgaccgcaucugcaccggcaucacguccagcaacagcccccacguggugaagaccgccacccagggggaggucaacgugaccggcgugaucccgcugacgaccacccccaccaagucccacuucgcgaaccucaaggggacgcagacccggggcaagcugugccccaacugccugaacugcaccgaccucgacgucgcccuggggcgccccaagugcaugggcaccaucccguccgccaaggccagcauccugcacgaggugaagcccgugacguccggcugcuuccccaucaugcacgaccggaccaagauccgccagcuccccaaccugcugcggggguacgagaacauccgccucagcgcccggaacgucaucaacgcggagaccgccccgggcgggcccuacaucgugggcaccuccgggagcugccccaacgugacgaacggcaagggcuucuucgccaccauggccugggcgguccccaagaacaagaacaagaccgccaccaacccgcugacgguggaggugcccuacaucugcaccaagggggaggaccagaucaccgucuggggcuuccacuccgacaacgaggcccagauggugacccuguacggggacagcaagccccagaaguucacguccagcgccaacggcgugaccacccacuacgucucccagaucggcggguuccccaaccagaccgaggacgagggccuccagcagagcgggcgcaucgugguggacuacaugguccagaagccgggcaagacggggaccaucguguaccagcggggcgugcugcugccccagaaggucuggugcgccuccggccgcagcaaggugaucaaggggucccucccccugaucggcgaggcggacugccugcacgagaaguacgggggccucaacaagagcaagcccuacuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguacaccagccacggcgcccacgggguggccguggcggccgaccucaaguccacccaggaggccaucaacaagaucaccaagaaccugaacagccuguccgagcucgaggucaagaaccugcagcggcugagcggcgccauggacgagcuccacaacgagauccuggagcuggacgagaagguggacgaccuccgcgccgacacgaucuccagccagaucgagcuggcggugcugcucuccaacgagggcaucaucaacagcgaggacgagcaccuccuggcccuggagcggaagcugaagaagaugcuggggcccuccgccgucgacaucggcaacgggugcuucgagaccaagcacaagugcaaccagaccugccucgaccgcaucgccgcgggcaccuucaacgccggggaguucagccugcccaccuucgacucccugaacaucacggccgccagccucaacgacgacggccuggacaaccacaccauccugcucuacuacuccaccgccgcgagcucccuggccgugacccugaugaucgccaucuucaucguguacauggucagccgggacaacguguuccugcuccaccuguccauccgcaag

SEQ ID NO: 13141 - RNA, 1737 nt, Artificial Sequence; identical to SEQ ID NO: 13140
  derived and/or modified sequence opt1 from anti-influenza_Chain

SEQ ID NO: 13142 - RNA, 1731 nt, Artificial Sequence
  derived and/or modified sequence opt1 from anti-influenza_Chain
auggagaccaucagccugaucaccauccuccugguggucacggccuccaacgccgacaagaucugcaucggccaccagagcaccaacuccaccgagaccguggacacgcugaccgagaccaacgugcccgucacccacgccaaggagcuccugcacacggagcacaacgggaugcugugcgccaccagccucggccacccgcugauccuggacacgugcaccaucgaggggcucguguacggcaaccccuccugcgaccugcugcucgggggccgcgaguggagcuacaucguggagcgguccagcgccgucaacgggaccugcuaccccggcaacguggagaaccuggaggagcugcgcacccucuucuccagcgccuccagcuaccagcggauccagaucuuccccgacaccaccuggaacgugacguacaccggcaccucccgcgccugcagcggguccuucuaccggagcaugcgcuggcugacccagaaguccggcuucuacccgguccaggacgcgcaguacacgaacaaccggggcaagagcauccuguucgugugggggauccaccacccgcccaccuacaccgagcagaccaaccucuacauccgcaacgacacgaccaccuccgugaccacggaggaccugaaccggaccuucaagcccgucaucggcccccgcccccuggugaacgggcuccagggccggaucgacuacuacuggagcgugcugaagcccgggcagacccugcgcguccggagcaacggcaaccucaucgcccccugguacggccacgugcuguccgggggcagccacgggcgcauccugaagaccgaccucaagggcgggaacugcgugguccagugccagacggagaagggcggccugaacuccacccugccguuccacaacaucagcaaguacgccuucgggaccugccccaaguacgugcgggugaacucccucaagcuggccgucggccugcgcaacgugcccgcgcggagcucccgcggccucuucggggccaucgccggguucaucgagggcggcuggcccgggcugguggccggcugguacggguuccagcacagcaacgaccagggcgucgggauggccgcggaccgggacuccacccagaaggccaucgacaagaucacgagcaaggugaacaacaucgucgacaagaugaacaagcaguacgagaucaucgaccacgaguucuccgagguggagacccgccugaacaugaucaacaacaagaucgacgaccagauccaggacgugugggccuacaacgccgagcuccugguccugcucgagaaccagaagacccuggacgagcacgacgccaacgugaacaaccuguacaacaaggugaagcgggcgcucggcagcaacgccauggaggacggcaaggggugcuucgagcuguaccacaagugcgacgaccagugcauggagaccauccgcaacggcaccuacaaccgccggaaguaccgcgaggagucccggcuggagcgccagaagaucgagggggucaagcucgagagcgagggcacguacaaguccggccggcuggugccgcgcgggagccccggcuccggguacauccccgaggcgccccgggacggccaggccuacgugcgcaaggacggggaguggguccugcucagcaccuuccugggcaagccgauccccaacccccugcugggccucgacuccaccggg

SEQ ID NO: 13143 - RNA, 1731 nt, Artificial Sequence; identical to SEQ ID NO: 13142
  derived and/or modified sequence opt1 from anti-influenza_Chain

SEQ ID NO: 13144 - RNA, 1752 nt, Artificial Sequence
  derived and/or modified sequence opt1 from anti-influenza_Chain
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaagucccacuucgccaaccugaaggggacgcagacccggggcaagcucugccccaacugcuucaacugcaccgaccuggacguggcccuggggcgccccaagugcaugggcaacaccccguccgccaaggugagcauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgccgggcgggcccuacaaggugggcaccagcggguccugccccaacgucgccaacggcaacggcuucuucaacaccauggccugggugauccccaaggacaacaacaagaccgccaucaacccggugacggucgaggugcccuacaucugcagcgagggggaggaccagaucaccguguggggcuuccacuccgacgacaagacccagauggagcggcuguacggggacagcaacccccagaaguucaccuccagcgcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccguggccgccgaccucaaguccacccaggaggccaucaacaagaucaccaagaaccugaacuaccugagcgagcucgaggucaagaaccugcagcggcuguccggcgcgaugaacgagcuccacgacgagauccuggagcuggacgagaagguggacgaccuccgcgccgacaccaucagcucccagaucgagcuggccgugcugcucagcaacgagggcaucaucaacuccgaggacgagcaccuccuggcccuggagcggaagcugaagaagaugcuggggcccagcgccgucgagaucggcaacgggugcuucgagacgaagcacaagugcaaccagaccugccucgaccgcaucgcggccggcaccuucaacgccggggacuucucccugcccaccuucgacagccugaacaucaccgccgcgucccucaacgacgacggccuggacaaccacacgauccugcucuacuacagcaccgccgccuccagccuggccgugacccugaugaucgccaucuucaucguguacauggucucccgggacaacgugagcugcuccaucugccug

SEQ ID NO: 13145 - RNA, 1752 nt, Artificial Sequence
  derived and/or modified sequence opt1 from anti-influenza_Chain
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgaagacccggggcaagcucugccccgacugccugaacugcaccgaccuggacguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguacgagaacauccggcugagcacccagaacgugaucgacgccgagaaggcccccggcgggccguaccgccucggcacguccgggagcugccccaacgccaccuccaagagcggcuucuucgcgaccauggccugggccguccccaaggacaacaacaagaacgccaccaacccccugacgguggaggugccguacaucugcaccgagggcgaggaccagaucaccgucuggggguuccacuccgacgacaagacccagaugaagaaccuguacggcgacagcaacccccagaaguucacguccagcgccaacggggugaccacccacuacgugucccagaucggcggcuuccccgaccagaccgaggacgggggccucccccagagcgggcggaucgucguggacuacaugaugcagaagccgggcaagacggggaccaucguguaccagcgcggcguccugcugccccagaagguguggugcgcguccggccggagcaaggugaucaaggggagccucccccugaucggcgaggccgacugccugcacgagaaguacgggggccucaacaaguccaagcccuacuacaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaccugaacagccuguccgagcucgaggugaagaaccugcagcgccugagcggcgccauggacgagcuccacaacgagauccuggagcuggacgagaagguggacgaccuccgggcggacacgaucuccagccagaucgagcuggccguccugcucuccaacgagggcaucaucaacagcgaggacgagcaccuccuggcccuggagcgcaagcugaagaagaugcuggggcccuccgccguggacaucggcaacgggugcuucgagaccaagcacaagugcaaccagaccugccucgaccggaucgcggccggcaccuucaacgccggggaguucagccugcccaccuucgacucccugaacaucacggccgccagccucaacgacgacggccuggacaaccacaccauccugcuguacuacuccaccgcggccagcucccucgccgugacccugaugcuggccaucuucaucgucuacauggugagccgcgacaacguguccugcagcaucugccuc

SEQ ID NO: 13146 - RNA, 1752 nt, Artificial Sequence
  derived and/or modified sequence opt1 from anti-influenza_Chain
augaaggccaucaucgugcugcucauggucgugaccagcaacgccgaccgcaucugcaccggcaucacguccagcaacagcccccacguggucaagaccgcgacccagggggaggugaacgugaccggcgucaucccgcugacgaccacccccaccaaguccuacuucgccaaccugaaggggacgcggacccgcggcaagcucugccccgacugccugaacugcaccgaccuggacguggcccucgggcggcccaugugcgugggcaccacgccguccgccaaggccagcauccugcacgaggucaagcccgugaccuccggcugcuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggagcugccccaacgccaccuccaagagcggcuucuucgccaccauggcgugggccguccccaaggacaacaacaagaacgccaccaacccgcugacgguggaggugcccuacaucugcaccgagggcgaggaccagaucaccgucuggggguuccacuccgacgacaagacccagaugaagaaccuguacggcgacagcaacccccagaaguucacguccagcgccaacggggugaccacccacuacgugucccagaucggcagcuuccccgaccagaccgaggacggcgggcucccgcaguccggccggaucgucguggacuacaugaugcagaagcccgggaagacgggcaccaucguguaccagcgcgggguccugcugccccagaagguguggugcgccagcggccggagcaaggugaucaagggcucccucccccugaucggggaggcggacugccugcacgagaaguacggcgggcucaacaagagcaagccguacuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaacaagaucaccaagaaccugaacucccugagcgagcucgaggugaagaaccugcagcgccuguccggggccauggacgagcuccacaacgagauccuggagcuggacgagaagguggacgaccuccgggccgacacgaucagcucccagaucgagcuggcgguccugcucagcaacgagggcaucaucaacuccgaggacgagcaccuccuggcccuggagcgcaagcugaagaagaugcugggccccagcgccguggagaucgggaacggcugcuucgagaccaagcacaagugcaaccagaccugccucgaccggaucgccgcggggaccuucaacgccggcgaguucucccugcccaccuucgacagccugaacaucacggccgccucccucaacgacgacgggcuggacaaccacaccauccugcuguacuacagcaccgccgcguccagccucgccgugacccugaugcuggccaucuucaucgucuacauggugucccgcgacaacgugagcugcagcaucugccuc

SEQ ID NO: 13147 - RNA, 1752 nt, Artificial Sequence; identical to SEQ ID NO: 13144
  derived and/or modified sequence opt1 from anti-influenza_Chain

SEQ ID NO: 13148 - RNA, 1752 nt, Artificial Sequence; identical to SEQ ID NO: 13145
  derived and/or modified sequence opt1 from anti-influenza_Chain

SEQ ID NO: 13149 - RNA, 1752 nt, Artificial Sequence; identical to SEQ ID NO: 13146
  derived and/or modified sequence opt1 from anti-influenza_Chain

SEQ ID NO: 13150 - RNA, 1758 nt, Artificial Sequence
  derived and/or modified sequence opt1 from anti-influenza_Chain
augaaggccaucaucgugcugcucauggucgugaccagcaacgccgaccgcaucaucugcaccggcaucacguccagcaacagcccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugagcacccacaacgugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgagcuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcagccugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagccuguccgagcuggaggucaagaaccuccagcgccugagcggcgccauggacgagcugcacaacgagauccucgagcuggacgagaagguggacgaccugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucagccuccccacguucgacucccugaacaucaccgccgccagccugaacgacgacggccucgacaaccacaccauccugcuguacuacuccaccgccgccagcucccuggcggugacgcucaugaucgccaucuucguggucuacauggugagccgcgacaacguguccugcagcaucugccug

SEQ ID NO: 13151 - RNA, 1758 nt, Artificial Sequence; identical to SEQ ID NO: 13150
  derived and/or modified sequence opt1 from anti-influenza_Chain

SEQ ID NO: 13152 - RNA, 1749 nt, Artificial Sequence
  derived and/or modified sequence opt1 from anti-influenza_Chain
auggaggcccgccugcucgugcugcugugcgccuucgcggccaccaacgccgacaccaucugcaucggcuaccacgccaacaacagcacggacaccgucgacaccgugcucgagaagaacgugaccgucacgcacuccgugaaccugcuggaggacagccacaacgggaagcucugcaagcugaagggcaucgcgccccugcagcucgggaagugcaacaucgccggcuggcugcuggggaacccggagugcgaccuccugcugaccgccuccagcugguccuacaucguggagaccagcaacuccgagaacgggaccugcuaccccggcgacuucaucgacuacgaggagcuccgggagcagcugagcuccgucagcuccuucgagaaguucgagaucuuccccaagacgagcuccuggcccaaccacgagaccaccaagggggugaccgccgccugcagcuacgcgggcgccuccagcuucuaccgcaaccugcucuggcugacgaagaagggguccagcuacccgaagcuguccaagagcuacgugaacaacaagggcaaggagguccucgugcuguggggcgugcaccacccgcccaccggcaccgaccagcagagccuguaccagaacgccgacgccuacgucuccgugggcagcuccaaguacaaccggcgcuucacccccgagaucgccgcgcggcccaaggugcgcgaccaggccgggcggaugaacuacuacuggacgcuccuggagcccggcgacaccaucaccuucgaggccaccgggaaccugaucgcccccugguacgccuucgcgcucaaccgcggcagcggcuccgggaucaucacgagcgacgcccccguccacgacugcaacaccaagugccagaccccgcacggcgccaucaacuccagccugcccuuccagaacauccaccccgugaccaucggggagugccccaaguacgugcgguccacgaagcugcgcauggccaccggccuccggaacaucccgagcauccagucccgcgggcuguucggcgccaucgcgggcuucaucgagggcggguggaccgggaugaucgacggcugguacggguaccaccaccagaacgagcagggcagcggcuacgccgccgaccagaaguccacccagaacgccaucgacgggaucacgaacaaggucaacagcgugaucgagaagaugaacacccaguucaccgccgugggcaaggaguucaacaaccuggagcggcgcaucgagaaccucaacaagaaggucgacgacggguuccuggacaucuggaccuacaacgcggagcugcucgugcugcuggagaacgagcggacgcucgacuuccacgacuccaacgugcgcaaccuguacgagaaggucaagagccagcugaagaacaacgccaaggagaucggcaacgggugcuucgaguucuaccacaagugcgacgacgccugcauggaguccgugcggaacggcaccuacgacuaccccaaguacagcgaggaguccaagcucaaccgcgaggagaucgacggcgucaagcuggagagcauggggguguaccagagcggccggcuggugccccgcgggucccccggcagcggcuacaucccggaggcgccccgggacgggcaggccuacguccgcaaggacggcgagugggugcuccuguccaccuuccuggggaagcccauccccaacccgcuccugggccuggacagcaccggg

SEQ ID NO: 13153 - RNA, 1749 nt, Artificial Sequence; identical to SEQ ID NO: 13152
  derived and/or modified sequence opt1 from anti-influenza_Chain

SEQ ID NO: 13154 - RNA, 1755 nt, Artificial Sequence
  derived and/or modified sequence opt1 from anti-influenza_Chain
auggagcgcaccgugcugcuccuggccaccgucagccuggugaaguccgaccagaucugcaucggcuaccacgccaacaacagcacggagcaggucgacaccaucauggagaagaacgugaccgugacccacgcgcaggacauccucgagcggacgcacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccgggaacuucaacgacuacgaggagcugaagcaccuccugagccggaucaaccacuucgagaagauccagaucaucccgaaguccagcugguccaaccacgacgccagcuccggcgucagcuccgcgugccccuaccugggccgcagcuccuucuuccggaacgugguguggcucaucaagaagaacagcgccuaccccaccaucaagcgcuccuacaacaacaccaaccaggaggaccugcugguccucuggggcgugcaccaccccaacgacgccgccgagcagaccaagcuguaccagaacccgacgaccuacaucagcguggggaccuccacccugaaccagcggcucguccccgagaucgcgacgcgccccaaggugaacgggcagagcggccggauggaguucuucuggaccauccugaagcccaacgacgccaucaacuucgagagcaacgggaacuucaucgccccggaguacgccuacaagaucgugaagaagggcgacuccaccaucaugaaguccgagcuggaguacggcaacugcaacaccaagugccagacgcccaugggggccaucaacagcagcaugcccuuccacaacauccacccccucaccaucggcgagugcccgaaguacgucaaguccaaccgccuggugcuggcgaccgggcuccggaacacgccccagcgcgagcggcgccggaagaagcgcggccuguucggcgccaucgccggguucaucgagggcggguggcagggcaugguggacgggugguacggcuaccaccacagcaacgagcagggcuccugcuacagcgccgacaaggaguccacccagaaggccaucgacggggucaccaacaaggugaacagcaucaucaacaagaugaacacccaguucgaggcggugggccgggaguucaacaaccuggagcgccggaucgagaaccucaacaagaagauggaggacggguuccuggacgucuggaccuacaacgccgagcugcucgugcugauggagaacgagcgcacgcuggacuuccacgacuccaacgucaagaaccucuacgacaaggugcggcugcagcugcgcgacaacgccaaggagcucggcaacgggugcuucgaguucuaccacaagugcgacaacgagugcauggagagcgugaagaacggcaccuacgacuacccccaguacuccgaggaggcccgccugaaccgggaggagaucagcggcgucaagcuggaguccauggggaccuaccagagcggccgccucgugccccggggguccccgggcagcggguacauccccgaggcgccccgcgacggccaggccuacgugcggaaggacggcgaguggguccugcuguccaccuuccucgggaagcccaucccgaacccccugcugggccucgacagcacgggg

SEQ ID NO: 13155 - RNA, 1755 nt, Artificial Sequence; identical to SEQ ID NO: 13154
  derived and/or modified sequence opt1 from anti-influenza_Chain

SEQ ID NO: 13156 - RNA, 1947 nt, Artificial Sequence
  derived and/or modified sequence opt1 from anti-influenza_Chain
augggcgacaagaucaacuucaucuucgggauccacaaccaccagccccugggcaacuucggguggguguucgaggaggccuacgagaagugcuacuggccguuccucgagacccuggaggaguaccccaacaugaaggucgccauccacaccagcggcccccugaucgaguggcuccaggacaaccgccccgaguacaucgaccugcugcggucccucgugaagcgcggccagguggagaucgucguggcgggguucuacgagccggugcuggccagcauccccaaggaggaccggaucgagcagauccgccugaugaaggagugggccaaguccaucggcuucgacgcccgcggggucuggcucacggagcggguguggcagcccgagcuggugaagacccugaaggagagcggcaucgacuacgucaucguggacgacuaccacuucauguccgccgggcucagcaaggaggagcuguacuggcccuacuacaccgaggacggcggggaggugaucgcggucuucccgaucgacgagaagcugcgguaccucauccccuuccgccccguggacaaggugcuggaguaccugcacucccucaucgacggcgacgagagcaaggucgccguguuccacgacgacggcgagaaguucgggaucuggcccggcaccuacgaguggguguacgagaagggguggcugcgggaguucuucgaccgcaucuccagcgacgagaagaucaaccugaugcucuacacggaguaccuggagaaguacaagccgcggggccuggucuaccuccccaucgccuccuacuucgagaugagcgaguggucccugcccgccaagcaggcgcgccuguucguggaguucgugaacgagcucaaggucaagggcaucuucgagaaguaccggguguucgugcgcgggggcaucuggaagaacuucuucuacaaguaccccgagagcaacuacaugcacaagcggaugcugauggucuccaagcuggugcgcaacaacccggaggcccggaaguaccuccugcgcgcccagugcaacgacgccuacuggcacgggcuguucggcggggucuaccucccccaccuccggcgcgccaucuggaacaaccugaucaaggcgaacagcuacgugucccugggcaaggugauccgggacaucgacuacgacggcuucgaggagguccugaucgagaacgacaacuucuacgccguguucaagcccagcuacgggggcucccugguggaguucagcagcaagaaccgccucgucaacuacguggacgugcuggcccgccggugggagcacuaccacggguacgucgagucccaguucgacggcguggccagcauccacgagcuggagaagaagauccccgacgagauccgcaaggagguggccuacgacaaguaccggcgcuucaugcuccaggaccacgucgugccgcuggggaccacccuggaggacuucauguucucccggcagcaggagaucggcgaguucccccgcgugcccuacagcuacgagcuccuggacggcgggauccggcugaagcgcgagcaccucggcaucgaggucgagaagaccgugaagcuggugaacgacggguucgaggucgaguacaucgugaacaacaagacgggcaaccccgugcuguucgcggucgagcugaacguggccgugcaguccaucauggagagcccggggguccuccggggcaaggagaucgugguggacgacaaguacgccgucggcaaguucgcccugaaguucgaggacgagauggagguguggaaguaccccgugaagacccugucccagagcgaguccgggugggaccucauccagcagggcgucagcuacaucgugcccauccgccuggaggacaagauccgguucaagcugaaguucgaggaggccuccggg

SEQ ID NO: 13157 - RNA, 1947 nt, Artificial Sequence
  derived and/or modified sequence opt1 from anti-influenza_Chain
augagccgcaugacccugaaguccagcaugaagaagcgggugcucucccugcugaucgccgucguguuccucagccugaccggcguguuccccuccgggcugaucgagacgaaggucagcgccgcgaagaucaccgagaacuaccaguucgacucccgcauccggcucaacagcaucggcuucaucccgaaccacuccaagaaggccaccaucgccgccaacugcagcaccuucuacguggugaaggaggacgggacgaucgucuacaccggcaccgccaccuccauguucgacaacgacacgaaggagaccguguacaucgcggacuucagcuccgugaacgaggaggggaccuacuaccuggccguccccggcgugggcaagagcgugaacuucaagaucgccaugaacgucuacgaggacgccuucaagaccgcgaugcuggggauguaccuccugcgcugcggcacguccgugagcgccaccuacaacgggauccacuacucccacggccccugccacaccaacgacgccuaccuggacuacaucaacgggcagcacaccaagaaggacagcacgaagggcuggcacgacgccggcgacuacaacaaguacguggucaacgccgggaucaccgugggcuccauguuccucgcgugggagcacuucaaggaccagcuggagcccguggcccuggagaucccggagaagaacaacagcauccccgacuuccucgacgagcugaaguacgagaucgacuggauccugaccaugcaguaccccgacgggagcggccgggucgcccacaagguguccacccgcaacuucggcggguucaucaugcccgagaacgagcacgacgagcgguucuucgugccguggagcuccgccgccacggcggacuucgucgccaugaccgccauggccgcccgcaucuuccggcccuacgacccccaguacgcggagaagugcaucaacgccgccaaggugagcuacgaguuccucaagaacaaccccgccaacguguucgccaaccaguccggcuucagcaccggggaguacgcgaccgucuccgacgccgacgaccgccugugggccgccgcggagaugugggagacgcugggcgacgaggaguaccuccgggacuucgagaaccgcgccgcccaguucagcaagaagaucgaggccgacuucgacugggacaacguggccaaccuggggauguucaccuaccugcucuccgagcggccgggcaagaaccccgcgcugguccagagcaucaaggacucccugcucagcaccgccgacuccaucgugcgcaccagccagaaccacggcuacgggcggacgcugggcaccaccuacuacugggggugcaacggcaccgugguccgccagacgaugauccuccagguggccaacaagaucucccccaacaacgacuacgugaacgccgcccuggacgcgaucagccacgucuucgggcggaacuacuacaaccgcuccuacgugaccggccugggcaucaacccgcccaugaacccccacgaccggcgcagcggggccgacggcaucugggagcccuggcccggguaccuggugggcgggggcuggccgggccccaaggacugggucgacauccaggacuccuaccagaccaacgagaucgccaucaacuggaacgccgcccucaucuacgcgcuggccggguucgugaacuacaacagcccccagaacgaggugcuguacggcgacgucaacgacgacgggaaggugaacagcaccgaccucacgcugcugaagcgguacgugcucaaggccgucuccacccugcccagcuccaaggccgagaagaacgcggacgugaaccgcgacggccgcgugaacagcuccgacgucaccauccugagccgguaccucauccgcgugaucgagaagcugccgauc

SEQ ID NO: 13158 - RNA, 1947 nt, Artificial Sequence; identical to SEQ ID NO: 13156
  derived and/or modified sequence opt1 from anti-influenza_Chain

SEQ ID NO: 13159 - RNA, 1947 nt, Artificial Sequence; identical to SEQ ID NO: 13157
  derived and/or modified sequence opt1 from anti-influenza_Chain

SEQ ID NO: 13160 - RNA, 2046 nt, Artificial Sequence
  derived and/or modified sequence opt1 from anti-influenza_Chain
augaagcccagccacuucaccgagaagcgcuucaugaagaaggugcugggccucuuccuggucguggugaugcuggccuccgucggggugcucccgaccagcaaggugcaggccgcgggcacgaccgucaccuccauggaguacuucagccccgccgacgggcccgugaucuccaagagcggcguggggaaggccuccuacggcuucgucaugcccaaguucaacggcgggagcgccaccuggaacgacguguacuccgacgugggcgucaacgugaagguggggaacaacugggucgacaucgaccaggccggcggguacaucuacaaccagaacuggggccacuggagcgacggcggguucaacggcuacugguucacgcuguccgcgaccaccgagauccagcuguacagcaaggccaacggggugaagcucgaguaccagcugguguuccagaacaucaacaagaccacgaucaccgccaugaacccgacccagggcccccagaucaccgccuccuucacgggcggggcgggcuucaccuaccccaccuucaacaacgacagcgccgucaccuacgaggccguggccgacgaccugaagguguacgucaagcccgugaacuccagcuccuggaucgacaucgacaacaacgccgcgagcggguggaucuacgaccacaacuucggccaguucacggacgggggcggcggguacugguucaacgugaccgaguccaucaacgucaagcucgagagcaagaccagcuccgccaaccugguguacaccaucacguucaacgagccgacccggaacagcuacgucaucacccccuacgagggcaccacguucaccgccgacgccaacggguccaucggcaucccccugcccaagaucgacgggggcgccccgaucgcgaaggagcucggcaacuucguguaccagaucaacaucaacgggcaguggguggaccugagcaacuccagccaguccaaguucgccuacagcgccaacggcuacaacaacauguccgacgccaaccaguggggguacugggccgacuacaucuacggccugugguuccagcccauccaggagaacaugcagauccgcaucggguacccccucaacggccaggcgggcgggaacaucggcaacaacuucgucaacuacaccuucaucgggaaccccaacgccccgcggcccgacgugagcgaccaggaggacaucuccaucggcacccccacggaccccgccaucgccggcaugaaccugaucuggcaggacgaguucaacgggaccacccuggacaccagcaaguggaacuacgagacgggcuacuaccucaacaacgacccggccaccuggggguggggcaacgcggagcugcagcacuacaccaacuccacccagaacguguacguccaggacgggaagcugaacaucaaggccaugaacgacagcaaguccuucccccaggaccccaaccgcuacgcccaguacagcuccggcaagaucaacacgaaggacaagcucagccugaaguacggccggguggacuuccgcgccaagcugcccaccggggacggcguguggccggcgcucuggaugcugcccaaggacuccgucuacgggaccugggccgccagcggcgagaucgacgugauggaggcccgggggcgccugcccggcagcguguccggcaccauccacuucgggggccaguggcccgucaaccagagcuccgggggcgacuaccacuucccggaggggcagaccuucgccaacgacuaccacguguacagcguggucugggaggaggacaacaucaagugguacguggacggcaaguucuucuacaaggugacgaaccagcagugguacuccaccgcggcccccaacaaccccaacgccccguucgacgagcccuucuaccucaucaugaaccuggccgucggcgggaacuucgacggcgggcggacccccaacgccagcgacauccccgcgaccaugcaggucgacuacgugcgcguguacaaggagcag

SEQ ID NO: 13161 - RNA, 2046 nt, Artificial Sequence; identical to SEQ ID NO: 13160
  derived and/or modified sequence opt1 from anti-influenza_Chain

SEQ ID NO: 13162 - RNA, 2058 nt, Artificial Sequence
  derived and/or modified sequence opt1 from anti-influenza_Chain
augaccaagagcaucuacuucucccugggcauccacaaccaccagcccguggggaacuucgacuucgucaucgagcgcgccuacgagaugagcuacaagccgcucaucaacuucuucuucaagcaccccgacuuccccaucaacgugcacuucuccggcuuccugcugcucuggcuggagaagaaccaccccgaguacuucgagaagcugaagaucauggccgagcgggggcagaucgaguucgugagcggcggguucuacgagccgauccuccccaucauccccgacaaggacaagguccagcagaucaagaagcugaacaaguacaucuacgacaaguucggccagacccccaagggcauguggcuggcggagcgcgugugggagccgcaccucgugaaguacaucgccgaggccgggaucgaguacgucgugguggacgacgcccacuucuucuccgucggccugaaggaggaggaccuguucggguacuaccucauggaggagcagggcuacaagcuggccguguuccccaucagcaugaagcugcgguaccucauccccuucgcggaccccgaggagacgaucaccuaccuggacaaguucgccuccgaggacaagagcaagaucgcccugcuguucgacgacggggagaaguucggccuguggccggacaccuaccgcaccguguacgaggagggcuggcuggagacguucgucuccaagaucaaggagaacuuccuccuggugacccccgugaaccuguacaccuacaugcagcgggucaagcccaaggggcgcaucuaccuccccaccgccagcuaccgggagaugauggagugggugcuguucccggaggcgcagaaggagcuggaggagcucguggagaagcugaagacggagaaccugugggacaaguucucccccuacgucaagggcggguucuggcgcaacuuccucgccaaguacgacgagagcaaccacaugcagaagaagaugcuguacguguggaagaaggugcaggacucccccaacgaggaggucaaggagaaggccauggaggagguguuccagggccaggccaacgacgccuacuggcacggcaucuucgggggccuguaccucccccaccuccggaccgcgaucuacgagcaccugaucaaggccgagaacuaccucgagaacagcgagauccgcuucaacaucuucgacuucgacugcgacgggaacgacgagaucaucguggaguccccguucuucaaccuguaccugagccccaaccacggcggguccguccucgagugggacuucaagaccaaggccuucaaccugaccaacgugcugacgcggcgcaaggaggccuaccacagcaagcucuccuacgucaccagcgaggcccagggcaagagcauccacgagcgguggaccgcgaaggaggagggccuggagaacauccuguucuacgacaaccaccgccggguguccuucaccgagaagaucuucgagagcgagcccgugcucgaggaccuguggaaggacuccagccgccuggaggucgacuccuucuacgagaacuacgacuacgagaucaacaaggacgagaacaagauccggguccucuucagcgggguguuccgcggcuucgagcugugcaaguccuacauccuguacaaggacaagagcuucguggacgugguguacgagaucaagaacgucuccgagacgcccaucagccugaacuucgggugggagaucaaccucaacuuccuggccccgaaccaccccgacuacuacuuccugaucggcgaccagaaguacccccucuccagcuucgggaucgagaaggugaacaacuggaagaucuucuccggcaucggcaucgagcuggagugcgugcuggacgucgaggccagccucuaccgguaccccaucgagaccgugucccugagcgaggagggguucgagcgcguguaccagggcuccgcccugauccacuucuacaaggucgaccucccgguggggagcaccuggcggaccacgauccgcuucugggugaag

SEQ ID NO: 13163 - RNA, 2058 nt, Artificial Sequence; identical to SEQ ID NO: 13162
  derived and/or modified sequence opt1 from anti-influenza_Chain

SEQ ID NO: 13164 - RNA, 2115 nt, Artificial Sequence
  derived and/or modified sequence opt1 from anti-influenza_Chain
augcccaccaaccuguucuucaacgcccaccacagcccggugggcgccuucgcguccuucacccucggguuccccggcaagagcgggggccuggaccuggagcucgcccgcccgccccggcagaacguccugaucgggguggagucccugcacgagagcggccucuaccacgugcugcccuuccuggagacggccgaggaggacgaguccaagcgcuacgacaucgagaaccccgaccccaacccccagaagccgaacauccucauccccuucgccaaggaggagauccagcgggaguuccacgucgccaccgacaccuggaaggcgggcgaccugaccuucacgaucuacagccccgugaaggccgugcccaacccggagaccgccgacgaggaggagcugaagcucgcccugguccccgcggugaucguggagaugaccaucgacaacaccaacgggacgcgcgcccggcgcgccuucuucggcuucgaggggaccgaccccuacaccuccaugcggcgcaucgacgacacgugcccccagcugcggggcgucgggcagggccgcauccucagcaucguguccaaggacgagggcgugcggagcgcccugcacuucuccauggaggacauccugaccgcccagcucgaggagaacuggaccuucgggcugggcaaggucggggcgcugaucguggacgugccggccggcgagaagaagaccuaccaguucgccgucugcuucuaccgcggcggguacgugaccgccggcauggacgccagcuacuucuacacgcgguucuuccagaacaucgaggagguggggcucuacgcgcuggagcaggccgagguccugaaggagcaguccuuccgcagcaacaagcucaucgagaaggaguggcuguccgacgaccagaccuucaugauggcccacgccauccggagcuacuacggcaacacccagcugcucgagcacgaggggaagcccaucuggguggugaacgagggcgaguaccgcaugaugaacaccuucgaccugacggucgaccagcuguucuucgagcucaagcugaaccccuggaccgugaagaacgugcuggaccucuacgucgagcgguacuccuacgaggaccgcgugcgguuccccggcgaggagaccgaguacccgagcgggaucuccuucacccacgacaugggcgucgccaacacguucagccgcccccacuacagcuccuacgagcuguacgggaucagcggcugcuucucccacaugacccacgagcagcuggugaacugggugcucugcgcggccgucuacaucgagcagaccaaggacugggccuggcgggacaagcgccuggccauccuggagcagugccucgagagcauggugcgccgggaccaccccgaccccgagcagcgcaacggggugaugggccuggacuccacccggacgaugggcggggccgagaucaccaccuacgacagccuggacgucucccucggccaggcgcgcaacaaccuguaccuggccgggaagugcugggccgccuacguggcgcucgagaagcuguuccgggacgugggcaaggaggagcuggccgcccucgccggggagcaggccgagaagugcgcggccaccaucgucagccacgugacggacgacggcuacaucccggccaucaugggcgaggggaacgacuccaagaucauccccgccaucgagggccugguguuccccuacuucaccaacugccacgaggcccuggacgagaacgggcgcuucggcgcguacauccaggcccugcggaaccaccuccaguacguccugcgcgagggcaucugccuguuccccgacgggggcuggaagaucagcuccaccagcaacaacuccuggcucagcaagaucuaccugugccaguucaucgcccggcacauccuggggugggagugggacgagcagggcaagcgcgccgacgccgcgcacguggccuggcucacccacccgacgcuguccaucuggagcugguccgaccagaucaucgccggggagaucaccggcagcaaguacuacccccggggcgugaccuccauccuguggcucgaggagggggag

SEQ ID NO: 13165 - RNA, 2115 nt, Artificial Sequence; identical to SEQ ID NO: 13164
  derived and/or modified sequence opt1 from anti-influenza_Chain

SEQ ID NO: 13166 - RNA, 2148 nt, Artificial Sequence
  derived and/or modified sequence opt1 from anti-influenza_Chain
auggaggacuucgugcgccagugcuucaaccccaugaucgucgagcuggccgagaaggccaugaaggaguacggcgaggaccucaagaucgagaccaacaaguucgcggccaucugcacccaccuggaggugugcuucauguacagcgacuuccacuucaucaacgagcagggggaguccaucaucguggagccggaggaccccaacgcccugcucaagcaccgguucgagaucaucgagggccgcgaccggacgauggccuggaccgucgugaacagcaucugcaacaccaccggggccgagaagcccaaguuccugcccgaccuguacgacuacaaggagaaccgcuucaucgagaucggcgugacgcggcgcgagguccacaucuacuaccucgagaaggcgaacaagaucaaguccgagaagacccacauccacaucuucagcuucaccggggaggagauggccaccaaggccgacuacacgcuggacgaggagucccgggcccgcaucaagacccggcuguucaccauccgccaggagauggcgagccggggccucugggacuccuuccgccagagcgagcggggcgaggagaccaucgaggagcgcuucgagaucacggggaccaugcggcgccuggccgaccagucccugccgcccaacuucagcugccucgagaacuuccgggccuacguggacggcuucgagcccaacggguacaucgagggcaagcugucccagaugagcaaggaggugaacgcccgcaucgagcccuuccugcggaccaccccgcgccccauccggcuccccgacgggcccccgugcuuccagcgcuccaaguuccugcugauggacagccucaagcuguccaucgaggaccccagccacgagggcgagggcaucccccuguacgacgccaucaagugcaugcgcacguucuucggguggaaggagcccuccgucgugaagccgcacggcaaggggaucaaccccaacuaccuccugagcuggaagcagguccuggcggagcuccaggacaucgaguccgaggagaagaucccccggaccaagaacaugaagaagaccagccagcugaagugggcccugggcgagaacauggcccccgagaagguggacuucgacgacugcaaggacaucagcgaccucaagcaguacgacuccgacgagccggagcugcgcagccuguccagcuggauccagaacgaguucaacaaggccugcgagcucaccgacuccaucuggaucgagcuggacgagaucggcgaggacguggcccccaucgagcacaucgcgagcaugcggcgcaacuacuucacggccgaggugucccacugccgggccaccgaguacaucaugaagggggucuacaucaacaccgcccugcucaacgccagcugcgcggccauggacgacuuccagcugauccccaugaucuccaagugccgcaccaaggagggccggcgcaagacgaaccuguacggguucaucaucaagggccggagccaccuccgcaacgacaccgacguggugaacuucgucuccauggaguucagccugaccgacccccggcuggagccgcacaagugggagaaguacugcgugcucgagaucggggacaugcugcugcgcuccgccaucggccaggugagccggcccauguuccucuacguccgcaccaacggcacguccaagaucaagaugaagugggggauggagaugcggcgcugccugcugcagagccuccagcagaucgaguccaugaucgaggccgagagcuccgugaaggagaaggacaugaccaaggaguucuucgagaaccggagcgagaccuggcccaucggcgagagccccaaggggguggaggagggcuccaucgggaaggucugccgcacccugcuggccaagagcguguucaacucccucuacgcgagcccgcagcuggagggcuucuccgccgagagccggaagcugcugcucaucguccaggcccugcgcgacaaccuggagcccggcacguucgaccucgggggccuguacgaggccaucgaggagugccugaucaacgaccccugggugcuccugaacgcguccugguucaacagcuuccugacccacgcccuccgc

SEQ ID NO: 13167 - RNA, 2148 nt, Artificial Sequence; identical to SEQ ID NO: 13166
  derived and/or modified sequence opt1 from anti-influenza_Chain

SEQ ID NO: 13168 - RNA, 2256 nt, Artificial Sequence
  derived and/or modified sequence opt1 from anti-influenza_Chain
augaacaucaaccccuacuuccuguucaucgacgugccgauccaggccgccaucagcaccaccuuccccuacacgggcgucccgcccuacucccacgggaccggcaccggguacaccaucgacacggugauccgcacccacgaguacagcaacaagggcaagcaguacaucuccgacgugaccgggugcgucaugguggacccgaccaacggcccccuccccgaggacaacgagcccagcgcguacgcccagcuggacugcgugcuggaggcccucgaccggauggacgaggagcacccgggccuguuccaggccgggucccagaacgccauggaggcgcugauggucacgaccguggacaagcucacccagggccgccagaccuucgacuggacggugugccggaaccagcccgccgccaccgcccugaacaccaccaucacgagcuuccgccugaacgaccucaacggggcggacaagggcgggcugguccccuucugccaggacaucaucgacucccuggacaagcccgagaugaucuucuucaccgugaagaacaucaagaagaagcucccggccaagaaccggaagggcuuccugaucaagcgcauccccaugaaggugaaggaccggaucacccgcgucgaguacaucaagcgggcccugagccucaacaccaugacgaaggacgccgagcgcggcaagcugaagcggcgcgccaucgcgaccgccgggauccagauccggggcuucgugcugguggucgagaaccucgccaagaacaucugcgagaaccuggagcaguccgggcugcccgugggcggcaacgagaagaaggccaagcucagcaacgccguggcgaagaugcuguccaacugcccgcccgggggcaucagcaugaccgucaccggggacaacacgaaguggaacgagugccugaacccccgcaucuuccucgccaugaccgagcggaucacccgcgacucccccaucugguuccgggacuucugcagcaucgcccccgugcuguucuccaacaagaucgcccgccugggcaagggguucaugaucaccagcaagacgaagcggcucaaggcccagauccccugccccgaccuguucaacaucccccuggagcgcuacaacgaggagacccgggcgaagcucaagaagcugaagcccuucuucaacgaggagggcaccgccucccugagcccgggcaugaugauggggauguucaacaugcucuccaccgugcugggcgucgccgcccuggggaucaagaacaucggcaacaaggaguaccucugggacgggcugcagagcagcgacgacuucgcccuguucgugaacgcgaaggacgaggagacgugcauggagggcaucaacgacuucuaccggaccugcaagcuccugggcaucaacauguccaagaagaaguccuacugcaacgagaccgggauguucgaguucaccagcauguucuaccgcgacggcuucgugagcaacuucgccauggagcugcccuccuucggggucgccggcgugaacgagagcgccgacauggcgaucgggaugacgaucaucaagaacaacaugaucaacaacggcaugggccccgccaccgcccagaccgccauccagcuguucaucgccgacuaccgcuacaccuacaagugccaccgcggggacuccaaggucgagggcaagcggaugaagaucaucaaggagcucugggagaacaccaaggggcgcgacggccugcucguggcggacggcgggcccaaccuguacaaccugcggaaccuccacaucccggagaucauccugaaguacaacaucauggaccccgaguacaagggccgccugcugcacccccagaacccguucguggggcaccucagcaucgagggcaucaaggaggccgacaucacgcccgcccacgggcccaucaagaagauggacuacgacgccgucuccggcacccacagcuggcggaccaagcgcaaccgguccauccugaacaccgaccagcgcaacaugauccuggaggagcagugcuacgccaagugcugcaaccucuucgaggcgugcuucaacagcgccuccuaccggaagcccgugggccagcacagcaugcuggaggccauggcccaccgccugcggauggacgcccgccucgacuacgaguccgggcggaugagcaaggaggacuucgagaaggcgauggcccaccugggcgagaucggguacaug

SEQ ID NO: 13169 - RNA, 2256 nt, Artificial Sequence; identical to SEQ ID NO: 13168
  derived and/or modified sequence opt1 from anti-influenza_Chain

SEQ ID NO: 13170 - RNA, 2265 nt, Artificial Sequence
  derived and/or modified sequence opt1 from anti-influenza_Chain
auggccguggacaucaagaagaucaucaagcagaugacccuggaggagaaggccggccucugcagcgggcuggacuucuggcacaccaagcccgucgagcgccugggcaucccguccaucaugaugacggacgggccccacggccuccggaagcagcgcgaggacgcggagaucgccgacaucaacaacagcgugcccgcgaccugcuuccccuccgccgccgggcuggccugcagcugggaccgggagcugguggagcgcgucggcgccgcccucggcgaggagugccaggccgagaacguguccauccugcuggggccgggcgcgaacaucaagcggagcccccucugcgggcgcaacuucgaguacuucuccgaggaccccuaccugagcuccgagcuggccgccagccacaucaagggcgugcagucccagggggucggcgccugccucaagcacuucgccgcgaacaaccaggagcaccggcgcaugaccguggacaccaucguggacgagcggacgcugcgcgagaucuacuucgccagcuucgagaacgccgucaagaaggcccggcccuggguggugaugugcgccuacaacaagcugaacggcgaguacugcuccgagaaccgcuaccuccugaccgagguccugaagaacgaguggaugcacgacggguucguggugagcgacuggggcgcggucaacgaccggguguccgggcucgacgccggccuggaccuggagaugccgaccagccacggcaucaccgacaagaagaucguggaggccgucaaguccgggaagcucagcgagaacauccugaaccgcgccguggagcggauccugaaggugaucuucauggcccucgagaacaagaaggagaacgcgcaguacgacaaggacgcccaccaccgccuggcccggcaggccgccgcggaguccaugguccugcucaagaacgaggacgacgugcugccccugaagaaguccggcacgaucgcccucaucggggccuucgugaagaagccccgcuaccagggcagcgggagcagccacaucacccccacccggcuggacgacaucuacgaggagaucaagaaggccggcggcgacaaggucaaccugguguacuccgagggguaccgccucgagaacgacggcaucgacgaggagcugaucaacgaggcgaagaaggccgccagcuccagcgacgucgccgugguguucgccgggcugccggacgaguacgaguccgagggcuucgaccggacccacaugagcauccccgagaaccagaaccgccucaucgaggcggucgccgaggugcaguccaacaucguggucgugcugcugaacgggagccccguggagaugcccuggaucgacaaggucaaguccgugcucgaggccuaccugggcggccaggcccucgggggcgcccucgcggacgugcuguucggggaggucaacccgagcggcaagcuggccgagacguuccccgugaagcucucccacaaccccagcuaccugaacuuccccggggaggacgaccgcguggaguacaaggagggccuguucgucggcuaccgguacuacgacaccaaggggaucgagccgcuguuccccuucggccacgggcuguccuacaccaaguucgaguacagcgacaucuccguggacaagaaggacgugagcgacaacuccaucaucaacgucagcgugaaggugaagaacgucggcaagauggccggcaaggagaucgugcagcuguacgugaaggacgucaagagcuccgugcgccggcccgagaaggagcugaagggguucgagaagguguuccucaaccccggcgaggagaagaccgucacguucacccuggacaagcgcgccuucgccuacuacaacacccagaucaaggacuggcacguggagagcggggaguuccugauccucaucggccgguccagccgcgacaucgugcugaaggaguccguccgggugaacagcaccgugaagauccgcaagcgguucacggucaacuccgcgguggaggacgugaugagcgacuccagcgccgccgccguccuggggccggugcucaaggagaucaccgacgcgcugcagaucgacauggacaacgcccacgacaugauggccgccaacaucaagaacaugccccugcgcucccucgugggcuacagccagggccggcuguccgaggagaugcuggaggagcucgucgacaagaucaacaacguggag

SEQ ID NO: 13171 - RNA, 2265 nt, Artificial Sequence; identical to SEQ ID NO: 13170
  derived and/or modified sequence opt1 from anti-influenza_Chain

SEQ ID NO: 13172 - RNA, 2277 nt, Artificial Sequence
  derived and/or modified sequence opt1 from anti-influenza_Chain
auggagcgcaucaaggagcugcggaaccucaugagccagucccgcacccgggagauccugaccaagacgaccguggaccacauggccaucaucaagaaguacaccagcggccgccaggagaagaaccccgcccugcggaugaaguggaugauggcgaugaaguacccgaucaccgccgacaagcgcaucacggagaugauccccgagcggaacgagcaggggcagacccucugguccaagaugaacgacgccggcagcgaccgcgucauggugagcccccuggccgugaccugguggaaccggaacgggcccaugaccaacacgguccacuacccgaagaucuacaagaccuacuucgagcgcguggagcggcugaagcacggcaccuucgggcccgugcacuuccgcaaccaggucaagauccggcgccggguggacaucaaccccggccacgccgaccucuccgcgaaggaggcccaggacgugaucauggaggucguguuccccaacgaggugggcgcccgcauccugaccuccgagagccagcugacgaucaccaaggagaagaaggaggagcuccaggacugcaagaucuccccgcugauggucgccuacaugcuggagcgggagcucgugcgcaagacccgguuccugcccguggccgggggcaccagcuccgucuacaucgaggugcugcaccucacgcaggggaccugcugggagcagauguacacccccggcggggaggugaagaacgacgacgucgaccagagccugaucaucgccgcccgcaacaucgugcggcgcgccgccguguccgcggacccccuggccagccuccuggagaugugccacuccacccagaucggcggcauccgcauggucgacauccugaagcagaacccgacggaggagcaggccguggggaucugcaaggccgccaugggccuccggaucagcuccagcuucuccuucgggggcuucaccuucaagcgcaccagcggcagcuccgugaagcgggaggaggagguccugaccgggaaccugcagacgcucaagauccgcgugcacgagggcuacgaggaguucaccauggucgggcggcgcgcgaccgccauccugcggaaggccacccgccggcugauccagcucaucgugagcggccgcgacgagcaguccaucgccgaggccaucaucguggcgauggucuucagccaggaggacugcaugaucaaggccgugcgcggggaccugaacuucgugaaccgggccaaccagcggcugaaccccaugcaccagcuccugcgccacuuccagaaggacgccaagguccuguuccagaacuggggcguggagcccaucgacaacgugaugggcaugaucgggauccuccccgacaugacgccguccaucgagaugagcaugcggggcguccgcaucuccaagauggggguggacgaguacagcuccaccgagcggguggucgugagcaucgaccgcuuccugcgggugcgcgaccagcgcggcaacguccugcucucccccgaggaggugagcgagacccaggggaccgagaagcugacgaucaccuacuccagcuccaugaugugggagaucaacggccccgagagcgugcuggucaacaccuaccaguggaucauccggaacugggagaccgugaagauccaguggucccagaaccccacgaugcucuacaacaagauggaguucgagccguuccagagccuggugcccaaggccauccgcggccaguacuccggguucguccggacccuguuccagcagaugcgcgacgugcucggcaccuucgacaccgcgcagaucaucaagcugcugcccuucgccgccgcgcccccgaagcagagccggaugcaguucagcuccuucaccgugaacguccgcgggagcggcaugcggauccucgugcgcgggaacucccccguguucaacuacaacaaggcgacgaagcggcugaccguccugggcaaggacgccggcacccucaccgaggaccccgacgaggggacggccggcguggagagcgccgugcugcgcggguuccugauccugggcaaggaggaccggcgcuacggccccgcccucuccaucaacgagcugagcaaccuggcgaagggggagaaggccaacguccucaucggccagggggacguggugcuggucaugaagcggaagcgcgacuccagcauccugaccgacucccagaccgccaccaagcggauccgcauggccaucaac

SEQ ID NO: 13173 - RNA, 2277 nt, Artificial Sequence; identical to SEQ ID NO: 13172
  derived and/or modified sequence opt1 from anti-influenza_Chain

SEQ ID NO: 13174 - RNA, 2472 nt, Artificial Sequence
  derived and/or modified sequence opt1 from anti-influenza_Chain
augaugcugcgcaagaagaccaagcagcucaucagcagcauccugauccuggugcuccugcugagccucuuccccgccgcccuggcggccgagggcaacacccgggaggacaacuucaagcaccuccuggggaacgacaacgucaagcgccccuccgaggccggcgcccugcagcugcaggagguggacgggcagaugacgcucguggaccagcacggcgagaagauccagcugcgggggaugagcacccacggccugcagugguuccccgagauccucaacgacaacgccuacaaggcgcuguccaacgacugggacagcaacaugauccgccuggccauguacgucggcgagaacggguacgccaccaaccccgagcucaucaagcagcgggugaucgacggcaucgagcuggccaucgagaacgacauguacgugaucgucgacuggcacgugcacgcgcccggggacccgcgcgaccccguguacgccggcgccaaggacuucuuccgggagaucgccgcccuguaccccaacaacccccacaucaucuacgagcucgcgaacgagccguccagcaacaacaacgggggcgccggcauccccaacaacgaggagggguggaaggccgucaaggaguacgccgaccccaucguggagaugcugcgcaaguccggcaacgccgacgacaacaucaucaucguggggagccccaacuggucccagcggccggaccuggcggccgacaaccccaucgacgaccaccacaccauguacacgguccacuucuacaccggcagccacgccgccuccaccgagagcuaccccuccgagacccccaacagcgagcgcggcaacgugauguccaacacgcgguacgcccucgagaacgggguggcggucuucgccaccgaguggggcaccagccaggccuccggggacggcgggccguacuucgacgaggccgacguguggaucgaguuccugaacgagaacaacaucagcugggccaacuggagccugaccaacaagaacgagguguccggcgcguucacgcccuucgagcucggcaagagcaacgccaccaaccuggaccccgggcccgaccacgucugggccccggaggagcugucccucagcggcgaguacgugcgcgcccggaucaagggggugaacuacgagcccaucgaccgcaccaaguacaccaagguccugugggacuucaacgacggcacgaagcagggguucggcgugaacuccgacagccccaacaaggagcugaucgcgguggacaacgagaacaacacccucaaggucuccggccuggacgugagcaacgacgucuccgacgggaacuucugggccaacgcccggcugagcgccaacggcugggggaaguccguggacauccucggcgccgagaagcugaccauggacgugaucgucgacgagcccaccacgguggcgaucgccgccaucccgcagagcuccaagagcgggugggccaaccccgagcgcgccgugcgggucaacgcggaggacuucgugcagcagaccgacggcaaguacaaggccggccugaccaucaccggggaggacgcccccaaccucaagaacaucgccuuccacgaggaggacaacaacaugaacaacaucauccuguucgugggcacggacgccgcggacgucaucuaccuggacaacaucaaggugaucgggaccgagguggagauccccgucgugcacgacccgaagggcgaggccgugcuccccuccgucuucgaggacggcacccgccaggggugggacugggccggcgagagcggggugaagaccgcccugacgaucgaggaggcgaacggcuccaacgcccugagcugggaguucggguaccccgaggugaagccguccgacaacugggccaccgcgccccggcucgacuucuggaaguccgaccugguccgcggcgagaacgacuacguggccuucgacuucuaccuggaccccgugcgggccaccgagggcgccaugaacaucaaccucgucuuccagcccccgaccaacggguacugggugcaggcccccaagacguacaccaucaacuucgacgagcuggaggaggccaaccaggugaacggccuguaccacuacgaggucaagaucaacgugcgcgacaucaccaacauccaggacgacacccugcuccgcaacaugaugaucaucuucgccgacguggagagcgacuucgcggggcgggucuucguggacaacgugcgcuucgagggcgccgccacgaccgagcccgucgagcccgagccgguggaccccggggaggagaccccgcccguggacgagaaggaggccaagaaggagcagaaggaggccgagaaggaggagaaggaggcggucaaggaggagaagaaggaggccaaggaggagaagaaggccgugaagaacgaggccaagaagaag

SEQ ID NO: 13175 - RNA, 2472 nt, Artificial Sequence; identical to SEQ ID NO: 13174
  derived and/or modified sequence opt1 from anti-influenza_Chain

SEQ ID NO: 13176 - RNA, 3063 nt, Artificial Sequence
  derived and/or modified sequence opt1 from anti-influenza_Chain
auggccggcccccaccgcagccgggccgcggggccgccgcccuucgccguggacgagcacgucgcccuggagaugguggccuuccgcggcgagguguucgccgggcacggccuccuggcggaccagcggcugaucgcccacaccgggcgccccgcccucaacgcccagcggaucacccagcagaagcagcgcgaccagugccggggccagcgccaccggcaccaccagggcgggcgcaaccugcggaaggcgcaccgcacguuccacgagcaccaguccacccaggaccaggcccacgacgcgccccacggccagcaggccaagaccgggcacgagggccuggggcacgagcacgcccaggcccagcaccagcagggccagagcaacgucguggaccggcaggacggcgagcccguggaggcccagcaccagaaggacggggcccagcgcgccggcaacgcccccgcggggcgggucgagcucgagcagcagcccguggaggcccagcaccagcagcaggagggcgacgugcgcaucggcaagcggcgccagaacgccuucgccccgcccgcccuggaccacguccacgggggccccgggcggcugcagcgccacggccucgcgguggagcggcacgugcccgccguccagcagcaccagcagcgcgugcagcgcgggcggcagcagaucgaccacgugcugggccacggccugccggggcgccagcggcucgccuuccgcgacggcccccggcgccccgucgggguggccucccccgugcugggccagcggccgugccccgggcaccgcaucguccagaaccuguuccggcacggcaucgaccccugccgcgugggccggugccgccggagccccuccgagcuccacgggaugggcugcgccgacgugcgcgcgcgggggcacggccgccacaugcgggggcagcgcgacgagcacccgggccggggccgccccugcgcccgccggcgccacgucgacgacgaccgggaccgcacgccccaggagaagcuguacgacguggcccgggggcuggacgagcccgcccgccgggugcacuucgacgacgaggcggaccgcagcgucuuccggggccucgcccagccggcccccgacgagcccgaggggcgccggcgcgaccggcuggugcugcagcgccaguccgucaaccaccggcgcggccggcucagccgccaccggcagcagcaccagccccagcagcagcgcccgcacggcaaccaggccuuccuggggaaguacgagaagcggcgccgcaagcccaccgccugccugaagucccuccggcgcuuccccgacaaggacgcgccggugcuguacuucgugaaccagcuggagaagaccaagcggcgcaugacccuccugcuggucuggcucaucuucaccggcguggccggggagauccggcuggaggccgaggacggcgagcugcucgggguggccgucgacagcacgcugaccggcuacuccggccgcggguacgugaccggcuucgacgcccccgaggacagcgugcgguucuccuucgaggcgccccgcggggucuaccgggugguguucggcgucagcuucuccagccgcuucgccuccuacgcccugcggguggacgacuggcaccagaccgggagccucaucaagcgcggcggcggguucuucgaggccuccaucggcgagaucuggcuggacgagggggcccacacgauggcguuccagcugaugaacggcgcccucgacuacgugcggcuggagcccgucagcuacgggccgcccgcccgcccgcccgcccagcugagcgacucccaggcgaccgccagcgcccaggcccucuucgccuuccugcuguccgaguacggccggcacauccucgcgggccagcagcagaaccccuaccgccgggacuucgacgccaucaacuacgugcgcaacgugaccgggaaggagcccgcccuggucagcuucgaccugaucgacuacucccccacccgggaggcccacggcguggugcacuaccagacgcccgaggacuggaucgccugggcggggcgcgacggcaucgucagccucauguggcacuggaacgccccgaccgaccugaucgaggaccccucccaggacugcuacuggugguacggguucuacacccgcugcaccacguucgacguggccgccgcccuggcggacaccagcuccgagcgguaccgccugcuccugcgggacaucgacgugaucgccgcccagcugcagaaguuccagcaggccgacauccccguccucuggcgcccccugcacgaggcggccggcggcugguucugguggggcgccaaggggccggagcccuucaagcagcuguggcggcuccuguacgagcgccuggugcaccaccacgggcuccacaaccugaucuggguguacacccacgagcccggcgccgccgagugguaccccggcgacgcguacgucgacaucguggggcgggacguguacgccgacgacccggacgcccugaugcgcagcgacuggaacgagcuccagacccuguucggcgggcggaagcuggucgcccucacggagaccggcacccugcccgacguggaggugaucaccgacuacgggaucuggugguccugguucagcaucuggacggaccccuuccugcgcgacgucgaccccgaccggcucacccgcguguaccacuccgagcgggugcugacccgcgacgagcugccggacuggcggagcuacguccuccacgccaccacggugcagcccgcgggcgaccuggcccuggccguguaccccaacccgggcgccgggcgccuccacgucgaggugggccugcccguggccgcgcccgucgugguggaggucuucaaccugcucgggcagcggguguuccaguaccaggccggcaugcagcccgccgggcuguggcgccgggccuucgagcuggcccucgcgccgggcguguaccugguccaggugcgcgccggcaaccugguggcccggcgccgcugggucuccgugcgg

SEQ ID NO: 13177 - RNA, 3063 nt, Artificial Sequence; identical to SEQ ID NO: 13176
  derived and/or modified sequence opt1 from anti-influenza_Chain

SEQ ID NO: 13178 - RNA, 3165 nt, Artificial Sequence
  derived and/or modified sequence opt1 from anti-influenza_Chain
augcgcaagaagcggcgcggcuuccugaacgccagcaccgccgugcucgucgggauccuggcgggcuuccuggggguggugcucgccgccaccggcgcccugggguucgccguccgggagucccugcuccugaagcaguuccuguuccucagcuucgagggcaacacggacggcgcgucccccuucgggaaggacgugguggucaccgccagccaggacguggccgccgacggcgaguacucccugaagguggagaaccgcaccagcgucugggacgggguggagaucgaccugaccggcaaggugaacacggggaccgacuaccuccuguccuuccacgucuaccagaccagcgacuccccgcagcuguucagcgugcucgcgcggaccgaggacgagaagggcgagcgcuacaagauccuggccgacaagguggucgugcccaacuacuggaaggagauccuggugcccuucucccccacguucgagggcaccccggccaaguucagccucaucaucaccucccccaagaagaccgacuucgucuucuacguggacaacgugcagguccugacgcccaaggaggccgggcccaaggugguguacgagaccagcuucgagaagggcaucggggacuggcagccgcggggcuccgacgucaagaucagcaucucccccaagguggcccacagcggcaagaagucccuguucgucagcaaccgccagaagggguggcacggcgcgcagaucagccucaaggggauccugaagaccggcaagaccuacgccuucgaggccuggguguaccaggaguccgggcaggaccagacgaucaucaugaccaugcagcggaaguacagcuccgacagcuccaccaaguacgaguggaucaaggccgccaccgugcccagcggccaguggguccagcuguccggcacguacaccauccccgcgggggugaccguggaggaccucacccuguacuucgagagccagaacccgacgcuggaguucuacgucgacgacgugaagguggucgacaccaccuccgccgagaucaagcucgagaugaaccccgaggaggagauccccgcccugaaggacgugcugaaggacuacuuccgcgugggcgucgcccuccccagcaagguguucaucaaccagaaggacaucgcccugaucuccaagcacagcaacuccagcaccgcggagaacgagaugaagccggacucccugcucgccgggaucgagaacggcaagcugaaguuccgguucgagacggccgacaaguacaucgaguucgcccagcagaacgggauggugguccgcggccacacccugguguggcacaaccagacccccgagugguucuucaaggacgagaacggcaaccuccugagcaaggaggagaugaccgagcggcugcgcgaguacauccacacgguggucgggcacuucaagggcaagguguacgccugggacguggucaacgaggcgguggaccccaaccagcccgacgggcuccggcgcuccaccugguaccagaucaugggcccggacuacaucgagcuggccuucaaguucgcccgggaggccgaccccaacgcgaagcuguucuacaacgacuacaacaccuucgagcccaagaagcgcgacaucaucuacaaccucgucaagagccugaaggagaaggggcugaucgacggcaucggcaugcagugccacaucucccucgccaccgacauccggcagaucgaggaggccaucaagaaguucagcacgauccccgggaucgagauccacaucaccgagcuggacaucagcguguaccgcgacuccaccagcaacuacuccgaggccccgcggaccgcccugaucgagcaggcgcacaagauggcccagcuguucaagaucuucaagaaguacagcaacgugaucaccaacgugacguucuggggccucaaggacgacuacuccuggcgcgccacccgccggaacgacuggccccugaucuucgacaaggacuaccaggccaagcuggccuacugggcgaucgucgcccccgaggugcugcccccgcuccccaaggagagcaagaucuccgagggggaggccguggucgugggcaugauggacgacagcuacaugauguccaagcccaucgagaucuacgacgaggagggcaacgugaaggccaccauccgcgccaucuggaaggacagcaccaucuacgucuacggggaggugcaggacgcgacgaagaagccggccgaggacggcguggccaucuucaucaaccccaacaacgagcggacccccuaccugcagcccgacgacaccuacgucgugcucuggaccaacuggaaguccgaggugaaccgcgaggacgucgaggugaagaaguucguggggccgggcuuccggcgcuacagcuucgagauguccaucacgauccccggggucgaguucaagaaggacagcuacaucggcuucgacguggccgugaucgacgacggcaagugguacuccuggagcgacaccaccaacucccagaagaccaacacgaugaacuacgggacccugaagcuggagggcgucaugguggcgaccgccaaguacgggacccccgugaucgacggcgagaucgacgacaucuggaacacgaccgaggagaucgagaccaagagcgucgccauggggagccucgagaagaacgccaccgccaaggugcgggugcugugggacgaggagaaccuguacguccucgcgaucgugaaggaccccguccugaacaaggacaacuccaacccgugggagcaggacagcguggagaucuucaucgacgagaacaaccacaagacgggcuacuacgaggacgacgacgcccaguuccgcgugaacuacaugaacgagcaguccuucggcaccggggccagcgccgcccgguucaagaccgcggucaagcugaucgagggcggguacaucguggaggccgccaucaaguggaagaccaucaagcccucccccaacacggugaucggcuucaacguccaggugaacgacgccaacgagaaggggcagcgcgugggcaucaucagcugguccgaccccaccaacaacagcuggcgggacccguccaaguucggcaaccuccgccugaucaag

SEQ ID NO: 13179 - RNA, 3165 nt, Artificial Sequence; identical to SEQ ID NO: 13178
  derived and/or modified sequence opt1 from anti-influenza_Chain

SEQ ID NO: 13180 - RNA, 3177 nt, Artificial Sequence
  derived and/or modified sequence opt1 from anti-influenza_Chain
augcagguccgcaagcggcgcggccugcucgacgugagcaccgccgugcugguggggauccuggccggcuuccucggggucgugcuggcggccuccggcgugcugagcuucgggaaggaggccuccagcaagggcgacuccagccucgagaccguccuggcccuguccuucgagggcacgaccgaggggguggugcccuucggcaaggacgucgugcucaccgccagccaggacguggcggccgacggggaguacucccugaaggucgagaaccggaccagcccgugggacggcguggagaucgaccugacggggaaggugaaguccggcgccgacuaccuccugagcuuccaggucuaccaguccagcgacgcgccccagcuguucaacgugguggcccgcaccgaggacgagaagggcgagcgguacgacgucauccucgacaaggugguggucuccgaccacuggaaggagauccuggugcccuucagccccaccuucgaggggaccccggccaaguacucccugaucaucguggccagcaagaacacgaacuucaacuucuaccucgacaagguccaggugcuggcccccaaggaguccggccccaaggucaucuacgagaccagcuucgagaacggggugggcgacuggcagccccgcggcgacgugaacaucgaggccagcuccgaggucgcgcacagcgggaaguccagccuguucaucuccaaccggcagaagggcuggcagggggcccagaucaaccucaagggcauccugaagaccgggaagaccuacgccuucgaggccuggguguaccagaacagcggccaggaccagacgaucaucaugaccaugcagcgcaaguacuccagcgacgccuccacccaguacgaguggaucaagagcgcgaccgugccguccggccaguggguccagcugagcgggacguacaccauccccgccggcgugaccguggaggaccucacccuguacuucgagucccagaaccccacgcuggaguucuacgucgacgacgugaagaucguggacaccaccagcgccgagaucaagaucgagauggagcccgagaaggagaucccggcccucaaggagguccugaaggacuacuucaagguggggguggcccugcccuccaaggucuuccucaaccccaaggacaucgagcugaucaccaagcacuucaacagcaucacggcggagaacgagaugaagcccgagucccugcucgccggcaucgagaacgggaagcugaaguuccgguucgagaccgccgacaaguacauccaguucguggaggagaacggcauggugauccgcggccacacccuggucuggcacaaccagaccccggacugguucuucaaggacgagaacgggaaccuccugagcaaggaggccaugacggagcggcugaaggaguacauccacaccguggugggccacuucaaggggaaggucuacgccugggacguggugaacgaggcggucgaccccaaccagcccgacggccuccgccgguccaccugguaccagaucauggggcccgacuacaucgagcuggccuucaaguucgcccgcgaggccgacccggacgcgaagcuguucuacaacgacuacaacaccuucgagccccggaagcgcgacaucaucuacaaccucgugaaggaccugaaggagaagggccugaucgacggcaucgggaugcagugccacaucagccucgccacggacaucaagcagaucgaggaggccaucaagaaguucagcaccauccccggcaucgagauccacaucaccgagcuggacauguccguguaccgggacagcuccagcaacuaccccgaggccccgcgcaccgcccugaucgagcaggcgcacaagaugaugcagcuguucgagaucuucaagaaguacuccaacgucaucacgaacgugaccuucugggggcucaaggacgacuacagcuggcgggccacccgccggaacgacuggccccugaucuucgacaaggaccaccaggccaagcuggccuacugggccaucguggcgcccgagguccugcccccgcuccccaaggagucccgcaucagcgagggcgaggccgugguggucggcaugauggacgacuccuaccugaugagcaagcccaucgagauccucgacgaggaggggaacgugaaggccaccauccgcgccguguggaaggacuccaccaucuacaucuacggcgagguccaggacaagacgaagaagccggccgaggacgggguggcgaucuucaucaaccccaacaacgagcggacccccuaccugcagcccgacgacaccuacgccgugcuguggaccaacuggaagacggaggucaaccgcgaggacguccaggugaagaaguucgugggcccgggguuccggcgcuacagcuucgagauguccaucaccauccccggcguggaguucaagaaggacagcuacaucggcuucgacgccgccgugaucgacgacgggaagugguacuccuggagcgacaccaccaacucccagaagacgaacaccaugaacuacggcacccucaagcuggaggggaucauggucgcgaccgccaaguacggcacgcccgugaucgacggggagaucgacgagaucuggaacaccaccgaggagaucgagaccaaggccguggccaugggcagccuggacaagaacgccacggcgaagguccgggugcucugggacgagaacuaccuguacgugcuggccaucgucaaggaccccgugcucaacaaggacaacagcaacccgugggagcaggacuccgucgagaucuucaucgacgagaacaaccacaagaccggcuacuacgaggacgacgacgcccaguuccgcgugaacuacaugaacgagcagaccuucgggaccggcgggagccccgcccgguucaagacggccgugaagcugaucgagggcggguacaucgucgaggcggccaucaaguggaagaccaucaagcccacccccaacaccgugaucggcuucaacauccaggugaacgacgccaacgagaagggccagcgcgucgggaucaucuccuggagcgacccgacgaacaacuccuggcgggaccccagcaaguucggcaaccugcgccucaucaag

SEQ ID NO: 13181 - RNA, 3177 nt, Artificial Sequence; identical to SEQ ID NO: 13180
  derived and/or modified sequence opt1 from anti-influenza_Chain

SEQ ID NO: 13182 - RNA, 318 nt, Artificial Sequence
  derived and/or modified sequence opt1 from anti-OX40_LightChain
gagaucguggucacccagagccccgccacccugucccucagcccgggcgagcgcgccacgcuguccugccgggcgagccaguccgugagcuccuaccuggccugguaccagcagaagcccgggcaggcgccccgccuccugaucuacgacgccagcaaccgggccaccggcauccccgcccgcuucuccgggagcggcuccgggaccgacuucacccugacgaucagcucccucgagccggaggacuucgccguguacuacugccagcagcggagcaacuggcccaccuucggccagggcaccaaggucgagaucaag

SEQ ID NO: 13183 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggggaucagcuccuggcucgcgugguaccagcagaagccggagaaggcccccaagagccugaucuacgccgccuccagccugcaguccggcgugcccagccgcuucuccgggagcggcuccgggaccgacuucacccucaccaucagcucccugcagcccgaggacuucgccacguacuacugccagcaguacaacagcuacccgcccaccuucggcggcgggaccaagguggagaucaag

SEQ ID NO: 13184 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacacccucccgcccaccuucggccaggggacgaagguggagaucaag

SEQ ID NO: 13185 - RNA, 321 nt, Artificial Sequence
  derived and/or modified sequence opt1 from anti-OX40_LightChain
gacauccagaugacccagagccccuccagccucuccgccagcgugggcgaccgcgucaccaucacgugccgggccucccaggacaucagcaacuaccucaacugguaccagcagaagccggggaagaccgugaagcugcugaucuacuacaccucccgccuccggagcggcgugcccucccgcuucagcggguccggcagcgggaccgacuucacgcugaccaucuccagccugcagcccgaggacuucgcgaccuacuacugccagcagggccacacccugcccccgacguucggccaggggaccaaggucgagaucaag

SEQ ID NO: 13186 - RNA, 321 nt, Artificial Sequence
  derived and/or modified sequence opt1 from anti-OX40_LightChain
gacauccagaugacccagagccccuccagccucuccgccagcgugggcgaccgcgucaccaucacgugccgggccucccaggacaucagcaacuaccucaacugguaccagcagaagccggggaagaccgugaagcugcugaucuacuacaccucccgccuccggagcggcgugcccucccgcuucagcggguccggcagcgggaaggacuacacccugacgaucuccagccugcagcccgaggacuucgcgaccuacuucugccagcagggccacacccugcccccgaccuucggccaggggacgaaggucgagaucaag

SEQ ID NO: 13187 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacacccucccggccaccuucggccaggggacgaagguggagaucaag

SEQ ID NO: 13188 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacaccgccccgcccaccuucggccaggggacgaagguggagaucaag

SEQ ID NO: 13189 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggcgccacccucccgcccaccuucggccaggggacgaagguggagaucaag

SEQ ID NO: 13190 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacgcccucccgcccaccuucggccaggggaccaagguggagaucaag

SEQ ID NO: 13191 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcaggcccacacccucccgcccaccuucggccagggcacgaagguggagaucaag

SEQ ID NO: 13192 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccagcagggccacacccucgccccgaccuucggccaggggacgaagguggagaucaag

SEQ ID NO: 13193 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccucccgccuccggagcggcgugcccucccgcuucagcggguccggcagcgggaccgacuucacccugacgaucuccagccugcagcccgaggacuucgccaccuacuacugccaggccggccacacccucccgcccaccuucggccaggggacgaagguggagaucaag

SEQ ID NO: 13194 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcgcccaagcugcugaucuacuacaccuccaagcuccacagcggcgugcccucccgcuucagcggguccggcagcgggaccgacuacacccugacgaucuccagccugcagcccgaggacuucgccaccuacuacugccagcagggcuccgcccucccguggaccuucggccaggggaccaagguggagaucaag

SEQ ID NO: 13195 - RNA, 321 nt, Artificial Sequence
  derived and/or modified sequence opt1 from anti-OX40_LightChain
gacauccagaugacccagagccccuccagccuguccgccagcgugggcgaccgcgucaccaucacgugccgggccucccaggacaucagcaacuaccucaacugguaccagcagaagccggggaaggcggugaagcugcugaucuacuacaccuccaagcuccacagcggcgugcccucccgcuucagcggguccggcagccggaccgacuacacccugacgaucuccagccugcagcccgaggacuucgccaccuacuacugccagcagggguccgcccuccccuggaccuucggccagggcaccaaggucgagaucaag

SEQ ID NO: 13196 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucuccguguggggccaggggacccuggucaccgugagcucc

SEQ ID NO: 13197 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacaacggcgacagcuccuacaaccagaaguuccgggagcgcgugacgaucaccgucgacaccagcaccuccacggccuaccuggagcugagcucccuccggagcgaggacaccgccguguacuacugcgugcuggcgccccgcugguacuucuccgucuggggccaggggacccuggugaccgugagcucc

SEQ ID NO: 13198 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacaacggcgacagcuccuacaaccagaaguuccgggagcgcgugacgcugaccgucgacaccagcaccuccacggccuaccuggagcucagcucccugcggagcgaggacaccgccguguacuacugcgugcuggcgccccgcugguacuucuccgucuggggccaggggacccucgugaccgugagcucc

SEQ ID NO: 13199 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacgccuacaugagcugggugcgccaggccccggggcagggccucgaguggaucggggacauguaccccgacaacggcgacuccagcuacaaccagaaguuccgggagcgcgugacgaucacccgggacaccuccaccagcacggccuaccuggagcuguccagccuccgcuccgaggacaccgccgucuacuacugcgugcuggcgccccggugguacuucagcguguggggccaggggacccuggucaccguguccagc

SEQ ID NO: 13200 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgagagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucuccguguggggccaggggacccuggucaccgugagcucc

SEQ ID NO: 13201 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacgccgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucuccguguggggccagggcacccuggucaccgugagcucc

SEQ ID NO: 13202 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacaacgccgacgccagcuacaaccagaaguuccgggagcgcgugacgaucacccgggacaccuccaccagcacggccuaccuggagcuguccagccuccgcuccgaggacaccgcggucuacuacugcgugcuggcgccccggugguacuucagcguguggggccagggcacccuggucaccguguccagc

SEQ ID NO: 13203 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacgccagcuacaaccagaaguuccgggagcgcgugacgaucacccgggacaccuccaccagcacggccuaccuggagcuguccagccuccgcuccgaggacaccgccgucuacuacugcgugcuggcgccccggugguacuucagcguguggggccaggggacccuggucaccguguccagc

SEQ ID NO: 13204 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacagcggcgacuccagcuacaaccagaaguuccgggagcgcgugacgaucacccgggacaccuccaccagcacggccuaccuggagcuguccagccuccgcuccgaggacaccgccgucuacuacugcgugcuggcgccccggugguacuucagcguguggggccaggggacccuggucaccguguccagc

SEQ ID NO: 13205 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacagcuacauguccugggugcgccaggccccggggcagggccucgaguggaucggggacauguaccccgacaacggcagcuccagcuacaaccagaaguuccgggagcgcgugacgaucacccgggacaccuccaccagcacggccuaccuggagcuguccagccuccgcuccgaggacaccgccgucuacuacugcgugcuggcgccccggugguacuucagcguguggggccaggggacccuggucaccguguccagc

SEQ ID NO: 13206 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggccuccggcuacaccuucaccgacgccuacaugagcugggugcgccaggccccggggcagggccucgaguggaucggggacauguaccccgacaacgccgacgccuccuacaaccagaaguuccgggagcgcgugacgaucacccgggacaccagcaccuccacggcguaccuggagcugagcucccuccgcagcgaggacaccgccgucuacuacugcgugcuggcgccccggugguacuucuccguguggggccagggcacccuggucaccgugagcucc

SEQ ID NO: 13207 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucuccgccuggggccaggggacccuggugaccgucagcucc

SEQ ID NO: 13208 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgugcuggcgccccggugguacuucgccguguggggccaggggacccuggucaccguguccagc

SEQ ID NO: 13209 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcgcccuggcgccccggugguacuucuccguguggggccaggggacccuggugaccgucagcucc

SEQ ID NO: 13210 - RNA, 351 nt, Artificial Sequence
  derived and/or modified sequence opt1 from anti-OX40_HeavyChain
gaggugcagcugguccagagcggcgccgaggugaagaagcccggggccuccgugaaggucagcugcaaggcguccggcuacaccuucaccgacagcuacauguccugggugcgccaggccccggggcagggccucgaguggaucggggacauguaccccgacaacggcgacagcuccuacaaccagaaguuccgggagcgcgugacgaucacccgggacaccagcaccuccacggccuaccuggagcugagcucccuccgcagcgaggacaccgccgucuacuacugcguggccgcgccccggugguacuucuccguguggggccaggggacccuggucaccgugagcucc

SEQ ID NO: 13211 - RNA, 354 nt, Artificial Sequence
  derived and/or modified sequence opt1 from anti-OX40_HeavyChain
gaggugcagcuggucgagagcggcgggggccucgugcagcccgggggcucccugcgccugagcugcgccgccuccggguucaccuucagcuccuacagcaugaacugggugcggcaggcgccgggcaagggccucgagugggucuccuacaucagcuccagcuccagcaccaucgacuacgccgacuccgugaaggggcgcuucacgaucagccgggacaacgccaagaacucccuguaccugcagaugaacagccuccgcgacgaggacaccgccguguacuacugcgcccgggaguccggcugguaccuguucgacuacugggggcagggcacccuggucaccgugagcucc

SEQ ID NO: 13212 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgccagcaccccgggaagggccucgaguggaucggcuacaucagcuacaacgggaucacguaccacaaccccucccucaagagccggaucaccaucaaccccgacaccuccaagaaccaguucagccugcagcugaacuccgugaccccggaggacacggccgucuacuacugcgcgcgcuaccgguacgacuacgacggcgggcacgccauggacuacuggggccaggggacccuggugaccgugagcucc

SEQ ID NO: 13213 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguggaucggcuacaucagcuacaacgggaucacguaccacaaccccucccucaagagccggaucaccaucaaccgcgacaccuccaagaaccaguucagccugcagcugaacuccgugacccccgaggacacggccgucuacuacugcgcgcgguaccgcuacgacuacgacggcgggcacgccauggacuacuggggccaggggacccuggugaccgugagcucc

SEQ ID NO: 13214 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcgacuccuucagcuccggguacuggaacuggauccgcaagcaccccggcaaggggcucgaguacaugggcuacaucagcuacaacggcaucacguaccacaaccccucccucaagagccggaucaccaucaaccgcgacaccuccaagaaccaguacagccugcagcugaacuccgugacccccgaggacacggccgucuacuucugcgcgcgguaccgcuacgacuacgacgggggccacgccauggacuacugggggcagggcacccuggugaccgugagcucc

SEQ ID NO: 13215 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcgacuccuucagcuccggguacuggaacuggauccgcaagcaccccggcaaggggcucgaguacaucggcuacaucagcuacaacggcaucacguaccacaaccccucccucaagagccggaucaccaucaaccgcgacaccuccaagaaccaguacagccugcagcugaacuccgugacccccgaggacacggccgucuacuucugcgcgcgguaccgcuacgacuacgacgggggccacgccauggacuacugggggcagggcacccuggugaccgugagcucc

SEQ ID NO: 13216 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcgacuccuucagcuccggguacuggaacuggauccgcaagcaccccggcaaggggcucgaguacaucggcuacaucagcuacaacggcaucacguaccacaaccccucccucaagagccggaucaccaucaaccgcgacaccuccaagaaccaguucagccugcagcugaacuccgugacccccgaggacacggccgucuacuucugcgcgcgguaccgcuacgacuacgacgggggccacgccauggacuacugggggcagggcacccuggugaccgugagcucc

SEQ ID NO: 13217 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcgacuccuucagcuccggguacuggaacuggauccgcaagcaccccggcaaggggcucgaguacaucggcuacaucagcuacaacggcaucacguaccacaaccccucccucaagagccggaucaccaucaaccgcgacaccuccaagaaccaguacagccugcagcugaacuccgugacccccgaggacacggccgucuacuacugcgcgcgguaccgcuacgacuacgacgggggccacgccauggacuacugggggcagggcacccuggugaccgugagcucc

SEQ ID NO: 13218 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcgacuccuucagcuccggguacuggaacuggauccgcaagcaccccggcaaggggcucgaguacaucggcuacaucagcuacaacggcaucacguaccacaaccccucccucaagagccggaucaccaucaaccgcgacaccuccaagaaccaguucagccugcagcugaacuccgugacccccgaggacacggccgucuacuacugcgcgcgguaccgcuacgacuacgacgggggccacgccauggacuacugggggcagggcacccuggugaccgugagcucc

SEQ ID NO: 13219 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccccgacaccuccaagaaccaguacagccugcagcugaacuccgugaccccggaggacacggccgucuacuucugcgcgcgcuaccgguacgacuacgacggcgggcacgccauggacuacuggggccaggggacccuggugaccgugagcucc

SEQ ID NO: 13220 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccgcgacaccuccaagaaccaguacagccugcagcugaacuccgugacccccgaggacacggccgucuacuucugcgcgcgguaccgcuacgacuacgacggcgggcacgccauggacuacuggggccaggggacccuggugaccgugagcucc

SEQ ID NO: 13221 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccgcgacaccuccaagaaccaguacagccugcagcugaacuccgugacccccgaggacacggccgucuacuacugcgcgcgguaccgcuacgacuacgacggcgggcacgccauggacuacuggggccaggggacccuggugaccgugagcucc

SEQ ID NO: 13222 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccccgacaccuccaagaaccaguacagccugcagcugaacuccgugaccccggaggacacggccgucuacuacugcgcgcgcuaccgguacgacuacgacggcgggcacgccauggacuacuggggccaggggacccuggugaccgugagcucc

SEQ ID NO: 13223 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgccaucacguaccacaaccccucccucaagagccggaucaccaucaaccgcgacaccuccaagaaccaguacagccugcagcugaacuccgugacccccgaggacacggcggucuacuacugcgcccgguacaaguacgacuacgacgccgggcacgccauggacuacuggggccaggggacccuggugaccgugagcucc

SEQ ID NO: 13224 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgccaucacguaccacaaccccucccucaagagccggaucaccaucaaccgcgacaccuccaagaaccaguacagccugcagcugaacuccgugacccccgaggacacggcggucuacuacugcgcccgguaccgcuacgacuacgacgggggccacgccauggacuacugggggcagggcacccuggugaccgugagcucc

SEQ ID NO: 13225 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgggaucacguaccacaaccccucccucaagagccggaucaccaucaaccgcgacaccuccaagaaccaguacagccugcagcugaacuccgugacccccgaggacacggccgucuacuacugcgcgcgguacaaguacgacuacgacggcgggcacgccauggacuacuggggccaggggacccuggugaccgugagcucc

SEQ ID NO: 13226 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacuccgggaucacguaccacaaccccagccugaagucccggaucaccaucaaccgcgacaccagcaagaaccaguacucccugcagcucaacagcgugacccccgaggacacggccgucuacuacugcgcgcgguaccgcuacgacuacgacggcgggcacgccauggacuacuggggccaggggacccuggugaccguguccagc

SEQ ID NO: 13227 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacuccgggaucacguaccacaaccccagccugaagucccggaucaccaucaaccgcgacaccagcaagaaccaguacucccugcagcucaacagcgugacccccgaggacacggccgucuacuacugcgcgcgguacaaguacgacuacgacggcgggcacgccauggacuacuggggccaggggacccuggugaccguguccagc

SEQ ID NO: 13228 - RNA, 363 nt, Artificial Sequence
  derived and/or modified sequence opt1 from anti-OX40_HeavyChain
gaggugcagcugcaggagagcggccccucccucgucaagccgagccagacccugucccugaccugcagcgugacgggggacuccuucaccagcggcuacuggaacuggauccgcaaguuccccgggaaccggcucgaguacaugggcuacaucuccuacaacgccaucaccuaccacaaccccagccugaagucccgcaucagcaucacccgggacacguccaagaaccacuacuaccugcagcucaacagcgugaccaccgaggacaccgccacguacuucugcgcgcgcuaccgguacgacuacgacgggggccacgccauggacuacuggggccaggggacccuggucaccguguccagc

SEQ ID NO: 13229 - RNA, 363 nt, Artificial Sequence
  derived and/or modified sequence opt1 from anti-OX40_HeavyChain
caggugcagcugcaggagagcggccccgggcucgucaagccgucccagacccugagccugaccugcgccguguacggcggguccuucagcuccggcuacuggaacuggauccgcaagcaccccgggaagggccucgaguacaucggcuacaucagcuacaacgccaucacguaccacaaccccucccucaagagccggaucaccaucaaccgcgacaccuccaagaaccaguacagccugcagcugaacuccgugacccccgaggacacggcggucuacuacugcgcccgguacaaguacgacuacgacgggggccacgccauggacuacugggggcagggcacccuggugaccgugagcucc

SEQ ID NO: 13230 - RNA, 372 nt, Artificial Sequence
  derived and/or modified sequence opt1 from anti-OX40_HeavyChain
gaggugcagcuggucgagagcggcgggggccucgugcagcccgggcgcucccugcggcugagcugcgccgccuccggcuucaccuucgacgacuacgcgaugcacugggugcgccaggccccggggaagggccucgagugggucagcggcaucuccuggaacagcggguccaucggcuacgccgacagcgugaaggggcgguucaccaucucccgcgacaacgccaagaacagccuguaccugcagaugaacucccuccgggccgaggacacggcgcuguacuacugcgccaaggaccagagcaccgccgacuacuacuucuacuacggcauggacgugugggggcagggcaccaccgucacgguguccagc

SEQ ID NO: 13231 - RNA, 381 nt, Artificial Sequence
  derived and/or modified sequence opt1 from anti-OX40_LightChain
auggagacccccgcccagcuccuguuccugcugcuccuguggcugccggacaccacgggcgagaucgugcucacccagagccccgggacccugucccugagccccggcgagcgcgccauccucuccugccgggcgagccaguccgucagcuccagcuuccuggccugguaccagcagaagcccgggcaggccccgcgccugcucaucuacggcgccuucucccgggccaccgggauccccgaccgcuucagcggcuccggcagcgggacggacuucacccugaccaucucccggcuggagcccgaggacuucgcgguguacuacugccagcaguacgacagcucccgcaccuucggccaggggacgaagguggagaucaag

SEQ ID NO: 13232 - RNA, 381 nt, Artificial Sequence
  derived and/or modified sequence opt1 from anti-OX40_LightChain
auggaggcccccgcccagcuccuguuccugcugcuccuguggcugccggacaccaccggcgagaucgugcucacgcagagccccgcgacccugucccugagccccggggagcgcgccacccucuccugccgggccagccagggcgucuccagcuaccuggccugguaccagcagaagcccgggcaggccccgcgccugcucaucuacgacgcguccaaccgggccaccggcauccccgcccgcuucagcggguccggccccggcacggacuucacccugaccaucagcucccuggagcccgaggacuucgccguguacuacugccagcagcggagcaacuggcacccgaccuucgggcagggcacgaagguggagaucaag

SEQ ID NO: 13233 - RNA, 381 nt, Artificial Sequence
  derived and/or modified sequence opt1 from anti-OX40_LightChain
auggaggcccccgcccagcuccuguuccugcugcuccuguggcugccggacaccaccggcgagaucgugcucacgcagagccccgcgacccugucccugagccccggggagcgcgccacccucuccugccgggccagccaguccgucagcuccuaccuggccugguaccagcagaagcccggccaggccccgcgccugcucaucuacgacgcgagcaaccgggccaccgggauccccgcccgcuucuccggcagcggguccggcacggacuucacccugaccaucagcucccuggagcccgaggacuucgccguguacuacugccagcagcggagcaacuggcccaucaccuucggccaggggacgcgccucgagaucaag

SEQ ID NO: 13234 - RNA, 387 nt, Artificial Sequence
  derived and/or modified sequence opt1 from anti-OX40_LightChain
auggagacccccgcccagcuccuguuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccagccgggccacggggauccccgaccgcuucuccggcagcggcuccgggaccgacuucacccugaccaucagccggcuggagcccgaggacuucgcgguguacuacugccagcaguacgacuccagccucacguucggcgggggcaccaagguggagaucaagcgcacc

SEQ ID NO: 13235 - RNA, 390 nt, Artificial Sequence
  derived and/or modified sequence opt1 from anti-OX40_LightChain
auggacaugcgcgugcuggcccagcuccugggccugcuccugcugugcuuccccggggcccggugcgacauccagaugacccagagcccguccagccucuccgcgagcgucggcaaccgcgugaccaucacgugccgggccucccaggacaucagcuccuggcuggccugguaccagcagaagcccgagaaggcccccaagagccugaucuacgccgcguccagccuccaguccggggugcccagccgcuucuccggcagcggguccggcaccgacuucacccugaccaucagcucccugcagccggaggacuucgccacguacuacugccagcaguacaacagcuacccccucaccuucggccaggggacccggcuggagaucaagcgc

SEQ ID NO: 13236 - RNA, 408 nt, Artificial Sequence
  derived and/or modified sequence opt1 from anti-OX40_HeavyChain
auggacacccugugcagcacccuccugcugcucacgauccccuccugggugcugagccagaucacccugaaggaguccggcccgacccucgucaagcccacccagacgcugacccugagcugcaccuucuccggguucagccucuccaccagcggcgugggggugggcuggauccgccagccgcccgggaaggcccuggaguggcuggcccucauccacugggacgacgcggagcgguacucccccagccugaagucccgccugacgaucaccaaggacaccagcaagaaccaggucgugcucaccaugacgaacauggaccugguggacaccgccaccuacuacugcgcccacacccggggcgccuucgacaucuggggccaggggacgauggucaccguguccagc

SEQ ID NO: 13237 - RNA, 408 nt, Artificial Sequence
  derived and/or modified sequence opt1 from anti-OX40_HeavyChain
auggacacccugugcagcacccuccugcugcucacgauccccuccugggugcugagccagaucacccugaaggaguccggcccgacccucgucaagcccacccagacgcugacccugaccugcaccuucagcggguucucccucagcacguccggcgugggggugggcuggauccgccagccgcccgggaaggcccuggaguggcuggcccucaucuacugggacgaccacagccccuacucccccagccugaagucccggcugaccaucaccaaggacaccagcaagaaccaggucgugcucacgaugaccaacauggaccccguggacaccgcgaccuacuacugcgcccgcacgcggggcgccuucgacaucuggggccaggggaccauggucaccguguccagc

SEQ ID NO: 13238 - RNA, 420 nt, Artificial Sequence
  derived and/or modified sequence opt1 from anti-OX40_HeavyChain
auggaguggggccccugcuggguguuccuggucgugauccucgagggggugcagugcggcguccagcugguggagagcgggggcgggcuggugcagccgggcggcucccuccggcugagcugcgccgccuccggguucaccuucagcuccuacagcaugaacuggguccggcaggcgcccggcaaggggcuggaguggguguccuacaucagcuccagcuccagcaccaucuacuacgccgacuccgugaagggccgcuucacgaucagccgggacaacgccaagaacucccucuaccugcagaugaacagccugcgcgacgaggacaccgccgucuacuacugcgcccgcgggguguaccacaacggcugguccuucuucgacuacuggggccaggggacccuccugaccgugagcucc

SEQ ID NO: 13239 - RNA, 423 nt, Artificial Sequence
  derived and/or modified sequence opt1 from anti-OX40_HeavyChain
auggacacccugugcagcacccuccugcugcucacgauccccuccugggugcugagccagaucacccugaaggaguccggcccgacccucgucaagcccaagcagacccugacgcugaccugcaccuucagcggguucucccucagcaccuccggcaugggggugggcuggauccgccagccgcccgggaaggcccuggaguggcuggccgugaucuacugggacgaccaccagcucuacagccccucccucaagagccggcugacgaucaccaaggacaccuccaagaaccaggucgugcugaccaugacgaacauggaccccguggacaccgcgaccuacuacugcgcccaccgccggggcgccuuccagcacuggggccaggggacccuggucacggugagcuccgccagcaccaagggc

SEQ ID NO: 13240 - RNA, 462 nt, Artificial Sequence
  derived and/or modified sequence opt1 from anti-OX40_HeavyChain
augaccaugaucacccccagccuggugccguccagcgacccccucgucacggccgccuccgugcuggaguucgcgcugcucauccgccugaccaucggccaggccguggucagcacccaguccaccgggggcgggcuggugcagcccggccggagccuccgccuguccugcgccgccagcggguucacgcuggacgacuacggcaugcacugggugcggcaggcccccggcaaggggcucgagugggucuccggcaucagcuggaacuccgacagcaucggguacguggacuccgugaagggccgcuucaccaucagccgggacaacgcgaagaacucccuguaccugcagaugaacagccuccgcgucgaggacaccgcccuguacuacugcgugaaggacaucuccgggugguacagcuucgacuacuggggccagggcacccuggugacggucuccagc

SEQ ID NO: 13241 - RNA, 639 nt, Artificial Sequence
  derived and/or modified sequence opt1 from anti-OX40_LightChain
gagaucguggucacccagagccccgccacccugucccucagcccgggcgagcgcgccacgcuguccugccgggcgagccaguccgugagcuccuaccuggccugguaccagcagaagcccgggcaggcgccccgccuccugaucuacgacgccagcaaccgggccaccggcauccccgcccgcuucuccgggagcggcuccgggaccgacuucacccugacgaucagcucccucgagccggaggacuucgccguguacuacugccagcagcggagcaacuggcccaccuucggccagggcaccaaggucgagaucaagcgcaccguggccgcccccuccguguucaucuucccgcccagcgacgagcagcugaaguccgggacggcgagcgucgugugccugcucaacaacuucuacccccgggaggccaaggugcaguggaaggucgacaacgcccugcaguccggcaacagccaggagagcgugaccgagcaggacuccaaggacagcaccuacucccugagcuccacccucacgcugagcaaggccgacuacgagaagcacaagguguacgccugcgaggucacccaccaggggcuguccagccccgugaccaaguccuucaaccgcggcgagugc

SEQ ID NO: 13242 - RNA, 1350 nt, Artificial Sequence
  derived and/or modified sequence opt1 from anti-OX40_HeavyChain
gaggugcagcuggucgagagcggcgggggccucgugcagcccgggcgcucccugcggcugagcugcgccgccuccggcuucaccuucgacgacuacgcgaugcacugggugcgccaggccccggggaagggccucgagugggucagcggcaucuccuggaacagcggguccaucggcuacgccgacagcgugaaggggcgguucaccaucucccgcgacaacgccaagaacagccuguaccugcagaugaacucccuccgggccgaggacacggcgcuguacuacugcgccaaggaccagagcaccgccgacuacuacuucuacuacggcauggacgugugggggcagggcaccaccgucacgguguccagcgccuccaccaagggccccagcguguucccccuggcgcccugcucccgcagcaccuccgagagcaccgccgcccucgggugccuggucaaggacuacuucccggagcccgugacggugagcuggaacuccggcgcccugaccagcgggguccacaccuuccccgccgugcuccaguccagcggccuguacucccugagcuccguggucaccgugcccagcuccaacuucggcacgcagaccuacacgugcaacguggaccacaagccgagcaacaccaaggucgacaagaccguggagcggaagugcugcguggagugcccgcccugccccgcgccgcccgucgccgggcccuccguguuccucuucccgcccaagcccaaggacacccugaugaucagccgcacccccgaggugaccugcgucguggucgacgugucccacgaggaccccgaggugcaguucaacugguacgucgacggcguggaggugcacaacgccaagacgaagccccgggaggagcaguucaacagcaccuuccgcgucguguccgugcugaccgucgugcaccaggacuggcucaacgggaaggaguacaagugcaaggugagcaacaagggccugcccgcccccaucgagaagaccaucuccaagacgaaggggcagccccgggagccgcaggucuacacccugccgcccagccgcgaggagaugaccaagaaccaggugucccugaccugccucgugaagggcuucuaccccagcgacaucgccgucgagugggagagcaacggccagcccgagaacaacuacaagacgaccccgcccaugcuggacuccgacgggagcuucuuccucuacuccaagcugaccguggacaagagccgguggcagcagggcaacguguucuccugcagcgucaugcacgaggcgcugcacaaccacuacacccagaagucccucagccugucccccgggaag

SEQ ID NO: 13243 - RNA, 21 nt, Artificial Sequence
  derived and/or modified sequence opt1 from anti-HIV_VRC01_VRC02_NIH45-46_LightChain_CDR
ugccagcaguacgaguucuuc

SEQ ID NO: 13244 - RNA, 42 nt, Artificial Sequence
  derived and/or modified sequence opt1 from anti-HIV_VRC01_HeavyChain_CDR
acccgcggcaagaacugcgacuacaacugggacuucgagcac

SEQ ID NO: 13245 - RNA, 21 nt, Artificial Sequence
  derived and/or modified sequence opt1 from anti-HIV_3BNC60_LightChain_CDR
ugccagguguacgaguucauc

SEQ ID NO: 13246 - RNA, 36 nt, Artificial Sequence
  derived and/or modified sequence opt1 from anti-HIV_3BNC60_HeavyChain_CDR
gcccgccagcggagcgacuucugggacuucgacgug

SEQ ID NO: 13247 - RNA, 36 nt, Artificial Sequence
  derived and/or modified sequence opt1 from anti-HIV_5H/I1-BMV-D5_HeavyChain_CDR
gcccgcgacaaccccacccugcucggcagcgacuac

SEQ ID NO: 13248 - RNA, 33 nt, Artificial Sequence
  derived and/or modified sequence opt1 from anti-HIV_8ANC195_LightChain_CDR
ugccagcaguacgacaccuaccccggcaccuuc

SEQ ID NO: 13249 - RNA, 33 nt, Artificial Sequence
  derived and/or modified sequence opt1 from anti-HIV_CH01_CH02_CH03_LightChain_CDR
ugccagcaguacggcgggagccccuacaccuuc

SEQ ID NO: 13250 - RNA, 78 nt, Artificial Sequence
  derived and/or modified sequence opt1 from anti-HIV_CH01_HeavyChain_CDR
gcccgcggcaccgacuacaccaucgacgacgccgggauccacuaccagggcagcgggacguucugguacuucgaccug

SEQ ID NO: 13251 - RNA, 78 nt, Artificial Sequence
  derived and/or modified sequence opt1 from anti-HIV_CH02_HeavyChain_CDR
gcccgcggcaccgacuacaccaucgacgaccaggggcgguucuaccagggcagcgggacguucugguacuucgacuuc

SEQ ID NO: 13252 - RNA, 78 nt, Artificial Sequence
  derived and/or modified sequence opt1 from anti-HIV_CH03_HeavyChain_CDR
gcccgcggcaccgacuacaccaucgacgaccaggggaucuucuacaagggcagcgggacguucugguacuucgaccug

SEQ ID NO: 13253 - RNA, 33 nt, Artificial Sequence
  derived and/or modified sequence opt1 from anti-HIV_CH04_LightChain_CDR
ugccagcaguacggccgcagccccuacaccuuc

SEQ ID NO: 13254 - RNA, 78 nt, Artificial Sequence
  derived and/or modified sequence opt1 from anti-HIV_CH04_HeavyChain_CDR
gcccgcggcaccgacuacaccaucgacgaccaggggauccgguaccagggcagcgggacguucugguacuucgacgug

SEQ ID NO: 13255 - RNA, 54 nt, Artificial Sequence
  derived and/or modified sequence opt1 from anti-HIV_NIH45-46_HeavyChain_CDR
acccgcggcaaguacugcaccgcccgggacuacuacaacugggacuucgagcac

SEQ ID NO: 13256 - RNA, 90 nt, Artificial Sequence
  derived and/or modified sequence opt1 from anti-HIV_PG16_HeavyChain_CDR
gcccgcgaggccggcgggcccaucuggcacgacgacgugaaguacuacgacuucaacgacggcuacuacaacuaccacuacauggacguc

SEQ ID NO: 13257 - RNA, 36 nt, Artificial Sequence
  derived and/or modified sequence opt1 from anti-HIV_PGT122_LightChain_CDR
cacaucugggacagccgccggcccaccaacugggug

SEQ ID NO: 13258 - RNA, 72 nt, Artificial Sequence
  derived and/or modified sequence opt1 from anti-HIV_PGT122_HeavyChain_CDR
accaagcacggccgccggaucuacgggguggucgccuucaaggagugguucaccuacuucuacauggacgug

SEQ ID NO: 13259 - RNA, 36 nt, Artificial Sequence
  derived and/or modified sequence opt1 from anti-HIV_PGT123_LightChain_CDR
cacaucuacgacgcccgcggcgggaccaacugggug

SEQ ID NO: 13260 - RNA, 72 nt, Artificial Sequence
  derived and/or modified sequence opt1 from anti-HIV_PGT123_HeavyChain_CDR
gcccugcacggcaagcgcaucuacgggaucguggcccucggcgagcuguucaccuacuucuacauggacguc

SEQ ID NO: 13261 - RNA, 30 nt, Artificial Sequence
  derived and/or modified sequence opt1 from anti-HIV_PGT125_PGT128_LightChain_CDR
ggcagccugguggggaacugggacgucauc

SEQ ID NO: 13262 - RNA, 57 nt, Artificial Sequence
  derived and/or modified sequence opt1 from anti-HIV_PGT125_HeavyChain_CDR
uucgacggcgaggugcuggucuacaaccacuggcccaagccggccuggguggaccuc

SEQ ID NO: 13263 - RNA, 30 nt, Artificial Sequence
  derived and/or modified sequence opt1 from anti-HIV_PGT126_PGT127_LightChain_CDR
agcucccuggugggcaacugggacgucauc

SEQ ID NO: 13264 - RNA, 57 nt, Artificial Sequence
  derived and/or modified sequence opt1 from anti-HIV_PGT126_HeavyChain_CDR
uucgacggcgaggugcuggucuaccacgacuggcccaagccggccuggguggaccuc

SEQ ID NO: 13265 - RNA, 57 nt, Artificial Sequence
  derived and/or modified sequence opt1 from anti-HIV_PGT127_HeavyChain_CDR
uucggcggggaggugcuggucuaccgcgacuggcccaagccggccuggguggaccuc

SEQ ID NO: 13266 - RNA, 57 nt, Artificial Sequence
  derived and/or modified sequence opt1 from anti-HIV_PGT128_HeavyChain_CDR
uucggcggggaggugcugcgcuacaccgacuggcccaagccggccugggucgaccuc

SEQ ID NO: 13267 - RNA, 30 nt, Artificial Sequence
  derived and/or modified sequence opt1 from anti-HIV_PGT130_LightChain_CDR
agcucccuguucggccgcugggacgugguc

SEQ ID NO: 13268 - RNA, 57 nt, Artificial Sequence
  derived and/or modified sequence opt1 from anti-HIV_PGT130_HeavyChain_CDR
agcggcggggacauccuguacuacuacgaguggcagaagccccacugguucuccccg

SEQ ID NO: 13269 - RNA, 30 nt, Artificial Sequence
  derived and/or modified sequence opt1 from anti-HIV_PGT131_LightChain_CDR
agcucccugagcggccgcugggacaucgug

SEQ ID NO: 13270 - RNA, 57 nt, Artificial Sequence
  derived and/or modified sequence opt1 from anti-HIV_PGT131_HeavyChain_CDR
agcggcggggacauccuguacuacaucgaguggcagaagccccacugguucuacccg

SEQ ID NO: 13271 - RNA, 27 nt, Artificial Sequence
  derived and/or modified sequence opt1 from anti-HIV_PGT135_PGT136_PGT137_LightChain_CDR
cagcaguacgaggaguggccccgcacc

SEQ ID NO: 13272 - RNA, 54 nt, Artificial Sequence
  derived and/or modified sequence opt1 from anti-HIV_PGT135_HeavyChain_CDR
caccgccaccacgacguguucaugcugguccccaucgccggcugguucgacgug

SEQ ID NO: 13273 - RNA, 54 nt, Artificial Sequence
  derived and/or modified sequence opt1 from anti-HIV_PGT136_HeavyChain_CDR
cacaaguaccacgacaucuuccgcgugguccccguggccggcugguucgacccg

SEQ ID NO: 13274 - RNA, 54 nt, Artificial Sequence
  derived and/or modified sequence opt1 from anti-HIV_PGT137_HeavyChain_CDR
cacaaguaccacgacaucgugauggucgugcccaucgccggcugguucgacccg

SEQ ID NO: 13275 - RNA, 27 nt, Artificial Sequence
  derived and/or modified sequence opt1 from anti-HIV_PGT141_PGT142_PGT143_PGT144_LightChain_CDR
augcagggccugaaccgccccuggacc

SEQ ID NO: 13276 - RNA, 96 nt, Artificial Sequence
  derived and/or modified sequence opt1 from anti-HIV_PGT141_HeavyChain_CDR
ggcagcaagcaccgccugcgggacuacgugcucuacgacgacuacgggcugaucaacuaccaggaguggaacgacuaccuggaguuccucgacguc

SEQ ID NO: 13277 - RNA, 96 nt, Artificial Sequence
  derived and/or modified sequence opt1 from anti-HIV_PGT144_HeavyChain_CDR
ggcagcaagcaccgccugcgggacuacgugcucuacgacgacuacgggcugaucaaccagcaggaguggaacgacuaccuggaguuccucgacguc

SEQ ID NO: 13278 - RNA, 27 nt, Artificial Sequence
  derived and/or modified sequence opt1 from anti-HIV_PGT145_LightChain_CDR
augcagggccugcacagccccuggacc

SEQ ID NO: 13279 - RNA, 93 nt, Artificial Sequence
  derived and/or modified sequence opt1 from anti-HIV_PGT145_HeavyChain_CDR
ggcagcaagcaccgccugcgggacuacuuccucuacaacgaguacgggcccaacuacgaggaguggggcgacuaccuggccacccuggacgug

SEQ ID NO: 13280 - RNA, 21 nt, Artificial Sequence
  derived and/or modified sequence opt1 from anti-HIV_VRC-CH30_VRC-CH31_VRC-CH32_VRC-CH33_VRC-CH34_LightChain _CDR
ugccagcaguacgagaccuuc

SEQ ID NO: 13281 - RNA, 45 nt, Artificial Sequence
  derived and/or modified sequence opt1 from anti-HIV_VRC-CH30_VRC-CH31_VRC-CH32_VRC-CH34_HeavyChain_CDR
gcccgcgcccagaagcggggccgcagcgagugggcguacgcccac

SEQ ID NO: 13282 - RNA, 45 nt, Artificial Sequence
  derived and/or modified sequence opt1 from anti-HIV_VRC-CH33_HeavyChain_CDR
gcccgcgcccagaagcgggcgcgcagcgagugggccuacgcccac

SEQ ID NO: 13283 - RNA, 21 nt, Artificial Sequence
  derived and/or modified sequence opt1 from anti-HIV_VRC-PG04_LightChain_CDR
ugccagcagcuggaguucuuc

SEQ ID NO: 13284 - RNA, 48 nt, Artificial Sequence
  derived and/or modified sequence opt1 from anti-HIV_VRC-PG04_HeavyChain_CDR
gcccgccagaaguucuacaccggcgggcagggcugguacuucgaccug

SEQ ID NO: 13285 - RNA, 21 nt, Artificial Sequence
  derived and/or modified sequence opt1 from anti-HIV_VRC-PG04b_LightChain_CDR
ugccagcagguggaguucuuc

SEQ ID NO: 13286 - RNA, 48 nt, Artificial Sequence
  derived and/or modified sequence opt1 from anti-HIV_VRC-PG04b_HeavyChain_CDR
gcccgccagaaguucgagcggggcgggcagggcugguacuucgaccug

SEQ ID NO: 13287 - RNA, 21 nt, Artificial Sequence
  derived and/or modified sequence opt1 from anti-HIV_VRC03_LightChain_CDR
ugccagcaguucgaguucuuc

SEQ ID NO: 13288 - RNA, 48 nt, Artificial Sequence
  derived and/or modified sequence opt1 from anti-HIV_VRC03_HeavyChain_CDR
gugcgccggggcagcugcgacuacugcggggacuuccccuggcaguac

SEQ ID NO: 13289 - RNA, 21 nt, Artificial Sequence
  derived and/or modified sequence opt1 from anti-HIV_1TJG_P-Chain
gagcuggacaagugggccagc

SEQ ID NO: 13290 - RNA, 69 nt, Artificial Sequence
  derived and/or modified sequence opt1 from anti-HIV_2B1H_P-Chain
aacaacaccaagaagagcaucaagauccgcccccggcaggccuucuacgccaccaacggcaucaucggg

SEQ ID NO: 13291 - RNA, 69 nt, Artificial Sequence
  derived and/or modified sequence opt1 from anti-HIV_2B1A_P-Chain
aacaacacccgcaagagcauccaccugggccccgggcgggccuucuacgccaccggcgacaucaucggg

SEQ ID NO: 13292 - RNA, 57 nt, Artificial Sequence
  derived and/or modified sequence opt1 from anti-HIV_2B0S_P-Chain
aagcgcaagcggauccacaucggccccgggcgcgccuucuacaccaccaagaacgcc

SEQ ID NO: 13293 - RNA, 69 nt, Artificial Sequence
  derived and/or modified sequence opt1 from anti-HIV_3UJJ_P-Chain
aacaacacccgcaagagcauccggaucggccccgggcaggccuucuacgccaccggcgacaucaucggg

SEQ ID NO: 13294 - RNA, 69 nt, Artificial Sequence
  derived and/or modified sequence opt1 from anti-HIV_3UJI_P-Chain
uacaacaagcgcaagcggauccacaucggccccgggcgcgccuucuacaccaccaagaacaucaucggc

SEQ ID NO: 13295 - RNA, 75 nt, Artificial Sequence
  derived and/or modified sequence opt1 from anti-HIV_3MLZ_P-Chain
agcaacaacacccgcaagggcauccacaucgggcccggccgggccuucuacgccaccgggcagaucacgggcgac

SEQ ID NO: 13296 - RNA, 60 nt, Artificial Sequence
  derived and/or modified sequence opt1 from anti-HIV_3MLV_Q-Chain
aacaacacccgcaagcggauccgcgugggccccgggcagaccgucuacgccacgaacgcc

SEQ ID NO: 13297 - RNA, 69 nt, Artificial Sequence
  derived and/or modified sequence opt1 from anti-HIV_3MLU_P-Chain
aacaacacccgcaagagcauccggaucggccccgggcaggccuucuacgccaccggcgggaucaucggc

SEQ ID NO: 13298 - RNA, 60 nt, Artificial Sequence
  derived and/or modified sequence opt1 from anti-HIV_3MLR_P-Chain
aacaacaccaagaagggcaucgccaucgggcccggccgcacccuguacgcccgggagaag

SEQ ID NO: 13299 - RNA, 48 nt, Artificial Sequence
  derived and/or modified sequence opt1 from anti-HIV_4XCF_P-Chain
aacuggugggacaucaccaacuggcugugguacaucaagaagaagaag

SEQ ID NO: 13300 - RNA, 45 nt, Artificial Sequence
  derived and/or modified sequence opt1 from anti-HIV_4XBE_P-Chain
aacugguucgacaucaccaacuggcugugguacaucaagaagaag

SEQ ID NO: 13301 - RNA, 48 nt, Artificial Sequence
  derived and/or modified sequence opt1 from anti-HIV_4XAW_P-Chain
aacugguucgacaucaccaacuggcugugguacaucaagaagaagaag

SEQ ID NO: 13302 - RNA, 45 nt, Artificial Sequence
  derived and/or modified sequence opt1 from anti-HIV_2QSC_P-Chain
cgcaagcggauccacaucggccccgggcgcgccuucuacaccacc

SEQ ID NO: 13303 - RNA, 60 nt, Artificial Sequence
  derived and/or modified sequence opt1 from anti-HIV_3MLS_S-Chain
gccugccaggccuucuacgcgagcagcccccgcaaguccauccacaucggcgccugcgcc

SEQ ID NO: 13304 - RNA, 42 nt, Artificial Sequence
  derived and/or modified sequence opt1 from anti-HIV_3GO1_P-Chain
cgcaagcggauccacaucggccccgggcgcgccuucuacacc

SEQ ID NO: 13305 - RNA, 42 nt, Artificial Sequence
  derived and/or modified sequence opt1 from anti-HIV_4M1D_Q-Chain
ugccgcauccacaucggccccgggcgggccuucuacaccugc

SEQ ID NO: 13306 - RNA, 39 nt, Artificial Sequence
  derived and/or modified sequence opt1 from anti-HIV_3C2A_Q-Chain
aagagcauccaccugggccccgggcgcgccuucuacgcc

SEQ ID NO: 13307 - RNA, 12 nt, Artificial Sequence
  derived and/or modified sequence opt1 from anti-HIV_CDR
cagagcaagacc

SEQ ID NO: 13308 - RNA, 12 nt, Artificial Sequence
  derived and/or modified sequence opt1 from anti-HIV_CDR
gaccugaucgac

SEQ ID NO: 13309 - RNA, 15 nt, Artificial Sequence
  derived and/or modified sequence opt1 from anti-HIV_CDR
gaccacuacuggagc

SEQ ID NO: 13310 - RNA, 15 nt, Artificial Sequence
  derived and/or modified sequence opt1 from anti-HIV_CDR
ggccgcuucuggagc

SEQ ID NO: 13311 - RNA, 15 nt, Artificial Sequence
  derived and/or modified sequence opt1 from anti-HIV_CDR
aacuacuacuggacc

SEQ ID NO: 13312 - RNA, 15 nt, Artificial Sequence
  derived and/or modified sequence opt1 from anti-HIV_CDR
gacgccuacuggagc

SEQ ID NO: 13313 - RNA, 15 nt, Artificial Sequence
  derived and/or modified sequence opt1 from anti-HIV_CDR
gacagcuacuggucc

SEQ ID NO: 13314 - RNA, 15 nt, Artificial Sequence
  derived and/or modified sequence opt1 from anti-HIV_CDR
gacaacuacuggagc

SEQ ID NO: 13315 - RNA, 15 nt, Artificial Sequence
  derived and/or modified sequence opt1 from anti-HIV_CDR
aacagcuacuggacc

SEQ ID NO: 13316 - RNA, 15 nt, Artificial Sequence
  derived and/or modified sequence opt1 from anti-HIV_CDR
agcuacuacuggucc

SEQ ID NO: 13317 - RNA, 15 nt, Artificial Sequence
  derived and/or modified sequence opt1 from anti-HIV_CDR
agcuucggcaugcac

SEQ ID NO: 13318 - RNA, 15 nt, Artificial Sequence
  derived and/or modified sequence opt1 from anti-HIV_CDR
gccgccuuccagugg

SEQ ID NO: 13319 - RNA, 15 nt, Artificial Sequence
  derived and/or modified sequence opt1 from anti-HIV_CDR
cagcagcugcgcacc

SEQ ID NO: 13320 - RNA, 15 nt, Artificial Sequence
  derived and/or modified sequence opt1 from anti-HIV_CDR
cagcaguacgacagc

SEQ ID NO: 13321 - RNA, 15 nt, Artificial Sequence
  derived and/or modified sequence opt1 from anti-HIV_CDR
cagcagcuggccacc

SEQ ID NO: 13322 - RNA, 15 nt, Artificial Sequence
  derived and/or modified sequence opt1 from anti-HIV_CDR
gagagcuuccagugg

SEQ ID NO: 13323 - RNA, 15 nt, Artificial Sequence
  derived and/or modified sequence opt1 from anti-HIV_CDR
gagguguacgaguuc

SEQ ID NO: 13324 - RNA, 15 nt, Artificial Sequence
  derived and/or modified sequence opt1 from anti-HIV_CDR
gccagccuggaguuc

SEQ ID NO: 13325 - RNA, 15 nt, Artificial Sequence
  derived and/or modified sequence opt1 from anti-HIV_CDR
agcguguacgaguuc

SEQ ID NO: 13326 - RNA, 15 nt, Artificial Sequence
  derived and/or modified sequence opt1 from anti-HIV_CDR
gccgcccuggaguuc

SEQ ID NO: 13327 - RNA, 15 nt, Artificial Sequence
  derived and/or modified sequence opt1 from anti-HIV_CDR
gccguggucgaguuc

SEQ ID NO: 13328 - RNA, 15 nt, Artificial Sequence
  derived and/or modified sequence opt1 from anti-HIV_CDR
cagcuguucgaguuc

SEQ ID NO: 13329 - RNA, 15 nt, Artificial Sequence
  derived and/or modified sequence opt1 from anti-HIV_CDR
gccguguuccagugg

SEQ ID NO: 13330 - RNA, 15 nt, Artificial Sequence
  derived and/or modified sequence opt1 from anti-HIV_CDR
gccgugcuggaguuc

SEQ ID NO: 13331 - RNA, 15 nt, Artificial Sequence
  derived and/or modified sequence opt1 from anti-HIV_CDR
aacggcuucgacgug

SEQ ID NO: 13332 - RNA, 15 nt, Artificial Sequence
  derived and/or modified sequence opt1 from anti-HIV_CDR
cagcaguacgaguuc

SEQ ID NO: 13333 - RNA, 15 nt, Artificial Sequence
  derived and/or modified sequence opt1 from anti-HIV_CDR
cagcacuacgaguuc

SEQ ID NO: 13334 - RNA, 15 nt, Artificial Sequence
  derived and/or modified sequence opt1 from anti-HIV_CDR
cagguguacgagguc

SEQ ID NO: 13335 - RNA, 15 nt, Artificial Sequence
  derived and/or modified sequence opt1 from anti-HIV_CDR
cagguguacgaguuc

SEQ ID NO: 13336 - RNA, 15 nt, Artificial Sequence
  derived and/or modified sequence opt1 from anti-HIV_CDR
uucagcaaggagucc

SEQ ID NO: 13337 - RNA, 15 nt, Artificial Sequence
  derived and/or modified sequence opt1 from anti-HIV_CDR
cugaagcucagcucc

SEQ ID NO: 13338 - RNA, 15 nt, Artificial Sequence
  derived and/or modified sequence opt1 from anti-HIV_CDR
uacaaggugagcucc

SEQ ID NO: 13339 - RNA, 15 nt, Artificial Sequence
  derived and/or modified sequence opt1 from anti-HIV_CDR
cccccgcaggagagc

SEQ ID NO: 13340 - RNA, 15 nt, Artificial Sequence
  derived and/or modified sequence opt1 from anti-HIV_CDR
accgcccgcgacuac

SEQ ID NO: 13341 - RNA, 15 nt, Artificial Sequence
  derived and/or modified sequence opt1 from anti-HIV_CDR
augcagagcauccag

SEQ ID NO: 13342 - RNA, 15 nt, Artificial Sequence
  derived and/or modified sequence opt1 from anti-HIV_CDR
caccagcuggacacc

SEQ ID NO: 13343 - RNA, 15 nt, Artificial Sequence
  derived and/or modified sequence opt1 from anti-HIV_CDR
caccagcuggacagc

SEQ ID NO: 13344 - RNA, 15 nt, Artificial Sequence
  derived and/or modified sequence opt1 from anti-HIV_CDR
cagcagcugggcacc

SEQ ID NO: 13345 - RNA, 15 nt, Artificial Sequence
  derived and/or modified sequence opt1 from anti-HIV_CDR
cagaaggccaccacc

SEQ ID NO: 13346 - RNA, 15 nt, Artificial Sequence
  derived and/or modified sequence opt1 from anti-HIV_CDR
cuguucgccggcacc

SEQ ID NO: 13347 - RNA, 18 nt, Artificial Sequence
  derived and/or modified sequence opt1 from anti-HIV_CDR
gugcgcggcagcuccccc

SEQ ID NO: 13348 - RNA, 18 nt, Artificial Sequence
  derived and/or modified sequence opt1 from anti-HIV_CDR
ggccuccuguucgugguc

SEQ ID NO: 13349 - RNA, 18 nt, Artificial Sequence
  derived and/or modified sequence opt1 from anti-HIV_CDR
auggacuggaccuggagc

SEQ ID NO: 13350 - RNA, 18 nt, Artificial Sequence
  derived and/or modified sequence opt1 from anti-HIV_CDR
auggacuggaccuggcgc

SEQ ID NO: 13351 - RNA, 18 nt, Artificial Sequence
  derived and/or modified sequence opt1 from anti-HIV_CDR
augaagcaccugugguuc

SEQ ID NO: 13352 - RNA, 18 nt, Artificial Sequence
  derived and/or modified sequence opt1 from anti-HIV_CDR
auggacuggaucuggcgc

SEQ ID NO: 13353 - RNA, 18 nt, Artificial Sequence
  derived and/or modified sequence opt1 from anti-HIV_CDR
auggacuggaccuggacc

SEQ ID NO: 13354 - RNA, 18 nt, Artificial Sequence
  derived and/or modified sequence opt1 from anti-HIV_CDR
augaagcaccuguuccuc

SEQ ID NO: 13355 - RNA, 18 nt, Artificial Sequence
  derived and/or modified sequence opt1 from anti-HIV_CDR
cagcugcuccagagcaac

SEQ ID NO: 13356 - RNA, 18 nt, Artificial Sequence
  derived and/or modified sequence opt1 from anti-HIV_CDR
ggcgggagccccgagcac

SEQ ID NO: 13357 - RNA, 18 nt, Artificial Sequence
  derived and/or modified sequence opt1 from anti-HIV_CDR
cuggagggcaccgacuac

SEQ ID NO: 13358 - RNA, 18 nt, Artificial Sequence
  derived and/or modified sequence opt1 from anti-HIV_CDR
cagcaguaccccagcacc

SEQ ID NO: 13359 - RNA, 21 nt, Artificial Sequence
  derived and/or modified sequence opt1 from anti-HIV_CDR
aacaaccacgaccgccccagc

SEQ ID NO: 13360 - RNA, 21 nt, Artificial Sequence
  derived and/or modified sequence opt1 from anti-HIV_CDR
aacaaccaggaccgccccgcc

SEQ ID NO: 13361 - RNA, 21 nt, Artificial Sequence
  derived and/or modified sequence opt1 from anti-HIV_CDR
aacaacaacgaccgccccagc

SEQ ID NO: 13362 - RNA, 21 nt, Artificial Sequence
  derived and/or modified sequence opt1 from anti-HIV_CDR
aacaaccaggaccgccccagc

SEQ ID NO: 13363 - RNA, 21 nt, Artificial Sequence
  derived and/or modified sequence opt1 from anti-HIV_CDR
gacgacagcgaccgccccucc

SEQ ID NO: 13364 - RNA, 21 nt, Artificial Sequence
  derived and/or modified sequence opt1 from anti-HIV_CDR
ugggccagcacccgccacacc

SEQ ID NO: 13365 - RNA, 21 nt, Artificial Sequence
  derived and/or modified sequence opt1 from anti-HIV_CDR
ggcgccaccgcccgcgacuuc

SEQ ID NO: 13366 - RNA, 21 nt, Artificial Sequence
  derived and/or modified sequence opt1 from anti-HIV_CDR
gccagcaucaagcuggcccuc

SEQ ID NO: 13367 - RNA, 21 nt, Artificial Sequence
  derived and/or modified sequence opt1 from anti-HIV_CDR
cagcaguacggccgcagcccc

SEQ ID NO: 13368 - RNA, 21 nt, Artificial Sequence
  derived and/or modified sequence opt1 from anti-HIV_CDR
cagcaguacuacaucagcccc

SEQ ID NO: 13369 - RNA, 21 nt, Artificial Sequence
  derived and/or modified sequence opt1 from anti-HIV_CDR
cagcagagccacucccccagc

SEQ ID NO: 13370 - RNA, 21 nt, Artificial Sequence
  derived and/or modified sequence opt1 from anti-HIV_CDR
ggccgcugcgcccggcgcugg

SEQ ID NO: 13371 - RNA, 21 nt, Artificial Sequence
  derived and/or modified sequence opt1 from anti-HIV_CDR
cgcuuccuguucguggucgcc

SEQ ID NO: 13372 - RNA, 21 nt, Artificial Sequence
  derived and/or modified sequence opt1 from anti-HIV_CDR
augagcguguccuuccugauc

SEQ ID NO: 13373 - RNA, 21 nt, Artificial Sequence
  derived and/or modified sequence opt1 from anti-HIV_CDR
ggcagcuccaaccgcugcccc

SEQ ID NO: 13374 - RNA, 21 nt, Artificial Sequence
  derived and/or modified sequence opt1 from anti-HIV_CDR
augaagcaccugugguucuuc

SEQ ID NO: 13375 - RNA, 21 nt, Artificial Sequence
  derived and/or modified sequence opt1 from anti-HIV_CDR
gccagcugggacuucgacuuc

SEQ ID NO: 13376 - RNA, 21 nt, Artificial Sequence
  derived and/or modified sequence opt1 from anti-HIV_CDR
gagaucggcguggccgagcac

SEQ ID NO: 13377 - RNA, 21 nt, Artificial Sequence
  derived and/or modified sequence opt1 from anti-HIV_CDR
cagaaguacgacaccgccccc

SEQ ID NO: 13378 - RNA, 21 nt, Artificial Sequence
  derived and/or modified sequence opt1 from anti-HIV_CDR
cagcagagcuccagcaccccc

SEQ ID NO: 13379 - RNA, 21 nt, Artificial Sequence
  derived and/or modified sequence opt1 from anti-HIV_CDR
cagcagagcgccggcaccccc

SEQ ID NO: 13380 - RNA, 21 nt, Artificial Sequence
  derived and/or modified sequence opt1 from anti-HIV_CDR
cagcagagcuccagcaagccc

SEQ ID NO: 13381 - RNA, 21 nt, Artificial Sequence
  derived and/or modified sequence opt1 from anti-HIV_CDR
caggaguacaacaccuacacc

SEQ ID NO: 13382 - RNA, 21 nt, Artificial Sequence
  derived and/or modified sequence opt1 from anti-HIV_CDR
caggaguacaacaacuacaac

SEQ ID NO: 13383 - RNA, 21 nt, Artificial Sequence
  derived and/or modified sequence opt1 from anti-HIV_CDR
cacuacgacgcccuggacuac

SEQ ID NO: 13384 - RNA, 24 nt, Artificial Sequence
  derived and/or modified sequence opt1 from anti-HIV_CDR
gccaucuucaagggcgugcagugc

SEQ ID NO: 13385 - RNA, 24 nt, Artificial Sequence
  derived and/or modified sequence opt1 from anti-HIV_CDR
ggcccccugggggacuacgacuuc

SEQ ID NO: 13386 - RNA, 24 nt, Artificial Sequence
  derived and/or modified sequence opt1 from anti-HIV_CDR
cagcaguacggcagcucccugcgc

SEQ ID NO: 13387 - RNA, 24 nt, Artificial Sequence
  derived and/or modified sequence opt1 from anti-HIV_CDR
cagcaguacagccacuaccgcacc

SEQ ID NO: 13388 - RNA, 24 nt, Artificial Sequence
  derived and/or modified sequence opt1 from anti-HIV_CDR
caguacuacggcaugagcgugacc

SEQ ID NO: 13389 - RNA, 24 nt, Artificial Sequence
  derived and/or modified sequence opt1 from anti-HIV_CDR
cagcaguacgagaacuggcugacc

SEQ ID NO: 13390 - RNA, 24 nt, Artificial Sequence
  derived and/or modified sequence opt1 from anti-HIV_CDR
agcggcgugcacuacauggacguc

SEQ ID NO: 13391 - RNA, 24 nt, Artificial Sequence
  derived and/or modified sequence opt1 from anti-HIV_CDR
cagcaguacagcggcccccugacc

SEQ ID NO: 13392 - RNA, 24 nt, Artificial Sequence
  derived and/or modified sequence opt1 from anti-HIV_CDR
cagcaguacuacaccgugcccagc

SEQ ID NO: 13393 - RNA, 24 nt, Artificial Sequence
  derived and/or modified sequence opt1 from anti-HIV_CDR
cagcaguacggcagcuccaucacc

SEQ ID NO: 13394 - RNA, 24 nt, Artificial Sequence
  derived and/or modified sequence opt1 from anti-HIV_CDR
caccaguacaacaagugggacacc

SEQ ID NO: 13395 - RNA, 24 nt, Artificial Sequence
  derived and/or modified sequence opt1 from anti-HIV_CDR
cagcagagcuacaccaccccccug

SEQ ID NO: 13396 - RNA, 24 nt, Artificial Sequence
  derived and/or modified sequence opt1 from anti-HIV_CDR
cagcgcugggagaccaucgacuac

SEQ ID NO: 13397 - RNA, 24 nt, Artificial Sequence
  derived and/or modified sequence opt1 from anti-HIV_CDR
ugcagcuacgccggcuccuacacc

SEQ ID NO: 13398 - RNA, 24 nt, Artificial Sequence
  derived and/or modified sequence opt1 from anti-HIV_CDR
cagcaguacgacaaccugcccacc

SEQ ID NO: 13399 - RNA, 24 nt, Artificial Sequence
  derived and/or modified sequence opt1 from anti-HIV_CDR
cagcagugcacccugccccucacc

SEQ ID NO: 13400 - RNA, 24 nt, Artificial Sequence
  derived and/or modified sequence opt1 from anti-HIV_CDR
cagcagagcuacuccagcgugacc

SEQ ID NO: 13401 - RNA, 24 nt, Artificial Sequence
  derived and/or modified sequence opt1 from anti-HIV_CDR
cagcagagccacaccuccgugacc

SEQ ID NO: 13402 - RNA, 24 nt, Artificial Sequence
  derived and/or modified sequence opt1 from anti-HIV_CDR
cagcagaccuacgccagcgugacc

SEQ ID NO: 13403 - RNA, 24 nt, Artificial Sequence
  derived and/or modified sequence opt1 from anti-HIV_CDR
cagcaguacaacagcgacuacacc

SEQ ID NO: 13404 - RNA, 24 nt, Artificial Sequence
  derived and/or modified sequence opt1 from anti-HIV_CDR
caccuguacgugagccgccccguc

SEQ ID NO: 13405 - RNA, 24 nt, Artificial Sequence
  derived and/or modified sequence opt1 from anti-HIV_CDR
cagcaguacggccgcagcccccug

SEQ ID NO: 13406 - RNA, 24 nt, Artificial Sequence
  derived and/or modified sequence opt1 from anti-HIV_CDR
cagcaguacggcuccagcccccug

SEQ ID NO: 13407 - RNA, 24 nt, Artificial Sequence
  derived and/or modified sequence opt1 from anti-HIV_CDR
cagcaguacaacgacuggcccgcc

SEQ ID NO: 13408 - RNA, 24 nt, Artificial Sequence
  derived and/or modified sequence opt1 from anti-HIV_CDR
caccaguacggcagcucccagcgc

SEQ ID NO: 13409 - RNA, 24 nt, Artificial Sequence
  derived and/or modified sequence opt1 from anti-HIV_CDR
cagcagaccuacagcuccgugacc

SEQ ID NO: 13410 - RNA, 24 nt, Artificial Sequence
  derived and/or modified sequence opt1 from anti-HIV_CDR
cagcagaccuaccgcagcgugacc

SEQ ID NO: 13411 - RNA, 24 nt, Artificial Sequence
  derived and/or modified sequence opt1 from anti-HIV_CDR
cagcaguacggcagcuccuggacc

SEQ ID NO: 13412 - RNA, 24 nt, Artificial Sequence
  derived and/or modified sequence opt1 from anti-HIV_CDR
agcuccuacgccggcaucaacaac

SEQ ID NO: 13413 - RNA, 24 nt, Artificial Sequence
  derived and/or modified sequence opt1 from anti-HIV_CDR
cagaaguacggcagcucccugacc

SEQ ID NO: 13414 - RNA, 24 nt, Artificial Sequence
  derived and/or modified sequence opt1 from anti-HIV_CDR
augcaggcccuggagacccucggc

SEQ ID NO: 13415 - RNA, 24 nt, Artificial Sequence
  derived and/or modified sequence opt1 from anti-HIV_CDR
cagcaguacgccggcagccugacc

SEQ ID NO: 13416 - RNA, 24 nt, Artificial Sequence
  derived and/or modified sequence opt1 from anti-HIV_CDR
cgcaacuggggcaacuucgaccac

SEQ ID NO: 13417 - RNA, 27 nt, Artificial Sequence
  derived and/or modified sequence opt1 from anti-HIV_CDR
cagcagcacuacaccacccccuggacg

SEQ ID NO: 13418 - RNA, 27 nt, Artificial Sequence
  derived and/or modified sequence opt1 from anti-HIV_CDR
cagcagagcuucgccgugcccuacacc

SEQ ID NO: 13419 - RNA, 27 nt, Artificial Sequence
  derived and/or modified sequence opt1 from anti-HIV_CDR
cagcaguacaagagcuacuccggcacc

SEQ ID NO: 13420 - RNA, 27 nt, Artificial Sequence
  derived and/or modified sequence opt1 from anti-HIV_CDR
caccaguacgccuacagcccccgcacc

SEQ ID NO: 13421 - RNA, 27 nt, Artificial Sequence
  derived and/or modified sequence opt1 from anti-HIV_CDR
cagcaguacaacagcuucccgcccacc

SEQ ID NO: 13422 - RNA, 27 nt, Artificial Sequence
  derived and/or modified sequence opt1 from anti-HIV_CDR
cagcagaccuacagcaacccccgcaug

SEQ ID NO: 13423 - RNA, 27 nt, Artificial Sequence
  derived and/or modified sequence opt1 from anti-HIV_CDR
cagcaguacgaggacccgcccuggacc

SEQ ID NO: 13424 - RNA, 27 nt, Artificial Sequence
  derived and/or modified sequence opt1 from anti-HIV_CDR
caccaguacuucaacaccccccgcacc

SEQ ID NO: 13425 - RNA, 27 nt, Artificial Sequence
  derived and/or modified sequence opt1 from anti-HIV_CDR
caccaguacuucagcaccccccgcacc

SEQ ID NO: 13426 - RNA, 27 nt, Artificial Sequence
  derived and/or modified sequence opt1 from anti-HIV_CDR
cagcaccgcagcaacuggcccuggacc

SEQ ID NO: 13427 - RNA, 27 nt, Artificial Sequence
  derived and/or modified sequence opt1 from anti-HIV_CDR
cgcggccggcgccagaucggggacuac

SEQ ID NO: 13428 - RNA, 27 nt, Artificial Sequence
  derived and/or modified sequence opt1 from anti-HIV_CDR
cagcaguacggccugagccccuggacc

SEQ ID NO: 13429 - RNA, 27 nt, Artificial Sequence
  derived and/or modified sequence opt1 from anti-HIV_CDR
cagcagaccuacaccagccccaucacg

SEQ ID NO: 13430 - RNA, 27 nt, Artificial Sequence
  derived and/or modified sequence opt1 from anti-HIV_CDR
cagcaguacggcagcuccccgcccacc

SEQ ID NO: 13431 - RNA, 27 nt, Artificial Sequence
  derived and/or modified sequence opt1 from anti-HIV_CDR
cagcaguacggcaccagcuccugcacc

SEQ ID NO: 13432 - RNA, 27 nt, Artificial Sequence
  derived and/or modified sequence opt1 from anti-HIV_CDR
cagcaguacgacgacgcccccaucacc

SEQ ID NO: 13433 - RNA, 27 nt, Artificial Sequence
  derived and/or modified sequence opt1 from anti-HIV_CDR
ggcccccugcuccgcuaccuggacagc

SEQ ID NO: 13434 - RNA, 27 nt, Artificial Sequence
  derived and/or modified sequence opt1 from anti-HIV_CDR
ugccugaagaagaccagcuccuacgug

SEQ ID NO: 13435 - RNA, 27 nt, Artificial Sequence
  derived and/or modified sequence opt1 from anti-HIV_CDR
cagcaguacaaccacuggccccagacc

SEQ ID NO: 13436 - RNA, 27 nt, Artificial Sequence
  derived and/or modified sequence opt1 from anti-HIV_CDR
cagcaguacagcaaccugcccuacacc

SEQ ID NO: 13437 - RNA, 27 nt, Artificial Sequence
  derived and/or modified sequence opt1 from anti-HIV_CDR
cagcaguacgacaccuaccccggcacc

SEQ ID NO: 13438 - RNA, 27 nt, Artificial Sequence
  derived and/or modified sequence opt1 from anti-HIV_CDR
caggaguacagcuccacccccuacaac

SEQ ID NO: 13439 - RNA, 27 nt, Artificial Sequence
  derived and/or modified sequence opt1 from anti-HIV_CDR
ggcgccugggacgacacccuguacgug

SEQ ID NO: 13440 - RNA, 27 nt, Artificial Sequence
  derived and/or modified sequence opt1 from anti-HIV_CDR
gccgccugggacgacacccuguacgug

SEQ ID NO: 13441 - RNA, 27 nt, Artificial Sequence
  derived and/or modified sequence opt1 from anti-HIV_CDR
cagcaguacuacagcgacuccaucacc

SEQ ID NO: 13442 - RNA, 27 nt, Artificial Sequence
  derived and/or modified sequence opt1 from anti-HIV_CDR
cagcaguacggccgcagccccuacacc

SEQ ID NO: 13443 - RNA, 27 nt, Artificial Sequence
  derived and/or modified sequence opt1 from anti-HIV_CDR
cagcaguacaccaacuaccccuggacc

SEQ ID NO: 13444 - RNA, 27 nt, Artificial Sequence
  derived and/or modified sequence opt1 from anti-HIV_CDR
cagcagcgccacaacuggcccaucagc

SEQ ID NO: 13445 - RNA, 27 nt, Artificial Sequence
  derived and/or modified sequence opt1 from anti-HIV_CDR
cagcaguaccacaacuggccccgcacc

SEQ ID NO: 13446 - RNA, 27 nt, Artificial Sequence
  derived and/or modified sequence opt1 from anti-HIV_CDR
cagcagcgcagcaccuggcccccgacc

SEQ ID NO: 13447 - RNA, 27 nt, Artificial Sequence
  derived and/or modified sequence opt1 from anti-HIV_CDR
cagcaguacgacagcuucuccuggacc

SEQ ID NO: 13448 - RNA, 27 nt, Artificial Sequence
  derived and/or modified sequence opt1 from anti-HIV_CDR
cagcaguacaacaaccugcccgugacc

SEQ ID NO: 13449 - RNA, 27 nt, Artificial Sequence
  derived and/or modified sequence opt1 from anti-HIV_CDR
cagcaguacaaccgcuacagcuacacc

SEQ ID NO: 13450 - RNA, 27 nt, Artificial Sequence
  derived and/or modified sequence opt1 from anti-HIV_CDR
caggaguacuacauccugcccugcagc

SEQ ID NO: 13451 - RNA, 27 nt, Artificial Sequence
  derived and/or modified sequence opt1 from anti-HIV_CDR
cagcaguacgacaaccugcucgcccac

SEQ ID NO: 13452 - RNA, 27 nt, Artificial Sequence
  derived and/or modified sequence opt1 from anti-HIV_CDR
caccagugcgacaaccugaucgcccgc

SEQ ID NO: 13453 - RNA, 27 nt, Artificial Sequence
  derived and/or modified sequence opt1 from anti-HIV_CDR
cagcagagcuucuccacccuguggacc

SEQ ID NO: 13454 - RNA, 27 nt, Artificial Sequence
  derived and/or modified sequence opt1 from anti-HIV_CDR
caccagagcuacuccaccccgcccacc

SEQ ID NO: 13455 - RNA, 27 nt, Artificial Sequence
  derived and/or modified sequence opt1 from anti-HIV_CDR
cagcagggcuacagcacccccuggacc

SEQ ID NO: 13456 - RNA, 27 nt, Artificial Sequence
  derived and/or modified sequence opt1 from anti-HIV_CDR
cagcaguacagcaccacgccccgcacc

SEQ ID NO: 13457 - RNA, 27 nt, Artificial Sequence
  derived and/or modified sequence opt1 from anti-HIV_CDR
cagcuguacaacagcgugccccagacc

SEQ ID NO: 13458 - RNA, 27 nt, Artificial Sequence
  derived and/or modified sequence opt1 from anti-HIV_CDR
cagcagcgcaccagcuggccccagacc

SEQ ID NO: 13459 - RNA, 27 nt, Artificial Sequence
  derived and/or modified sequence opt1 from anti-HIV_CDR
cagcaguucaacaccuacagccagacc

SEQ ID NO: 13460 - RNA, 27 nt, Artificial Sequence
  derived and/or modified sequence opt1 from anti-HIV_CDR
augcagagccugcagacccccaucacc

SEQ ID NO: 13461 - RNA, 27 nt, Artificial Sequence
  derived and/or modified sequence opt1 from anti-HIV_CDR
cagcaguacaacagcuacccccugacc

SEQ ID NO: 13462 - RNA, 27 nt, Artificial Sequence
  derived and/or modified sequence opt1 from anti-HIV_CDR
cagcaguacaacagcuacuccggcacc

SEQ ID NO: 13463 - RNA, 27 nt, Artificial Sequence
  derived and/or modified sequence opt1 from anti-HIV_CDR
cagagcuacgacuccagccuguccggc

SEQ ID NO: 13464 - RNA, 27 nt, Artificial Sequence
  derived and/or modified sequence opt1 from anti-HIV_CDR
agccagggcaacaccgccaucgacuac

SEQ ID NO: 13465 - RNA, 27 nt, Artificial Sequence
  derived and/or modified sequence opt1 from anti-HIV_CDR
gaggagccccgcgacgccuucgaccug

SEQ ID NO: 13466 - RNA, 27 nt, Artificial Sequence
  derived and/or modified sequence opt1 from anti-HIV_CDR
cagcagagcuacaccacccccgugacg

SEQ ID NO: 13467 - RNA, 27 nt, Artificial Sequence
  derived and/or modified sequence opt1 from anti-HIV_CDR
gccggccgcgaggggugguucgacccc

SEQ ID NO: 13468 - RNA, 27 nt, Artificial Sequence
  derived and/or modified sequence opt1 from anti-HIV_CDR
cagcaguacuacagcaccccccacacc

SEQ ID NO: 13469 - RNA, 27 nt, Artificial Sequence
  derived and/or modified sequence opt1 from anti-HIV_CDR
cagcagagcuacuccaucgccggcacc

SEQ ID NO: 13470 - RNA, 27 nt, Artificial Sequence
  derived and/or modified sequence opt1 from anti-HIV_CDR
cagaacuacaacaagcccccgcgcacc

SEQ ID NO: 13471 - RNA, 27 nt, Artificial Sequence
  derived and/or modified sequence opt1 from anti-HIV_CDR
augcagagcauccagcugccccucacc

SEQ ID NO: 13472 - RNA, 27 nt, Artificial Sequence
  derived and/or modified sequence opt1 from anti-HIV_CDR
augcaggcccugcagaccagccucacc

SEQ ID NO: 13473 - RNA, 27 nt, Artificial Sequence
  derived and/or modified sequence opt1 from anti-HIV_CDR
cagcaguacagcuccagcccccgcacc

SEQ ID NO: 13474 - RNA, 27 nt, Artificial Sequence
  derived and/or modified sequence opt1 from anti-HIV_CDR
caggccugggacagcuccaccgccgug

SEQ ID NO: 13475 - RNA, 27 nt, Artificial Sequence
  derived and/or modified sequence opt1 from anti-HIV_CDR
cagcacuacaacaacuggcccuacacc

SEQ ID NO: 13476 - RNA, 27 nt, Artificial Sequence
  derived and/or modified sequence opt1 from anti-HIV_CDR
cagcaguacgaccgccugcccaucacc

SEQ ID NO: 13477 - RNA, 27 nt, Artificial Sequence
  derived and/or modified sequence opt1 from anti-HIV_CDR
cagcaguacggcagcucccccaucacc

SEQ ID NO: 13478 - RNA, 27 nt, Artificial Sequence
  derived and/or modified sequence opt1 from anti-HIV_CDR
cagcaguacgacguguggccccugacc

SEQ ID NO: 13479 - RNA, 27 nt, Artificial Sequence
  derived and/or modified sequence opt1 from anti-HIV_CDR
caccaguacgccuccagcccccgcacc

SEQ ID NO: 13480 - RNA, 27 nt, Artificial Sequence
  derived and/or modified sequence opt1 from anti-HIV_CDR
augcagagccugcaccuccccuacacc

SEQ ID NO: 13481 - RNA, 27 nt, Artificial Sequence
  derived and/or modified sequence opt1 from anti-HIV_CDR
cagcaguacuacuccagcccccugacc

SEQ ID NO: 13482 - RNA, 27 nt, Artificial Sequence
  derived and/or modified sequence opt1 from anti-HIV_CDR
cagcagcacgacaccuuccccuucacc

SEQ ID NO: 13483 - RNA, 27 nt, Artificial Sequence
  derived and/or modified sequence opt1 from anti-HIV_CDR
cagcagagcuacuccacccccuacacc

SEQ ID NO: 13484 - RNA, 27 nt, Artificial Sequence
  derived and/or modified sequence opt1 from anti-HIV_CDR
cagcaguacaagaccuaccccgugacc

SEQ ID NO: 13485 - RNA, 27 nt, Artificial Sequence
  derived and/or modified sequence opt1 from anti-HIV_CDR
cagcaguacuacagcacccccgugacc

SEQ ID NO: 13486 - RNA, 27 nt, Artificial Sequence
  derived and/or modified sequence opt1 from anti-HIV_CDR
cagcaguacaacuggcccccguucacc

SEQ ID NO: 13487 - RNA, 27 nt, Artificial Sequence
  derived and/or modified sequence opt1 from anti-HIV_CDR
augcagggcacccacuggcccuggacc

SEQ ID NO: 13488 - RNA, 27 nt, Artificial Sequence
  derived and/or modified sequence opt1 from anti-HIV_CDR
caccagugcggcuccagcccccgcacc

SEQ ID NO: 13489 - RNA, 27 nt, Artificial Sequence
  derived and/or modified sequence opt1 from anti-HIV_CDR
cagcaguacaacagcuacuuccgcacc

SEQ ID NO: 13490 - RNA, 27 nt, Artificial Sequence
  derived and/or modified sequence opt1 from anti-HIV_CDR
cagcaguaccacaacuggcccccgagc

SEQ ID NO: 13491 - RNA, 27 nt, Artificial Sequence
  derived and/or modified sequence opt1 from anti-HIV_CDR
augcagggcaccuacuggcuguggacc

SEQ ID NO: 13492 - RNA, 27 nt, Artificial Sequence
  derived and/or modified sequence opt1 from anti-HIV_CDR
cagcagggcuucagcgcccccuucacc

SEQ ID NO: 13493 - RNA, 27 nt, Artificial Sequence
  derived and/or modified sequence opt1 from anti-HIV_CDR
cagcaguacaacaccuacccccugacc

SEQ ID NO: 13494 - RNA, 27 nt, Artificial Sequence
  derived and/or modified sequence opt1 from anti-HIV_CDR
augcagggcacccacuggccccgcacc

SEQ ID NO: 13495 - RNA, 27 nt, Artificial Sequence
  derived and/or modified sequence opt1 from anti-HIV_CDR
uucggccgcacccccugguucgacccg

SEQ ID NO: 13496 - RNA, 27 nt, Artificial Sequence
  derived and/or modified sequence opt1 from anti-HIV_CDR
cagcaguacuucaccagcgugaucacc

SEQ ID NO: 13497 - RNA, 27 nt, Artificial Sequence
  derived and/or modified sequence opt1 from anti-HIV_CDR
caccacuacaugagcgaccugcagacc

SEQ ID NO: 13498 - RNA, 27 nt, Artificial Sequence
  derived and/or modified sequence opt1 from anti-HIV_CDR
caccacuacagcuccagcucccacacc

SEQ ID NO: 13499 - RNA, 27 nt, Artificial Sequence
  derived and/or modified sequence opt1 from anti-HIV_CDR
caccacuacaagagcgacugccagacc

SEQ ID NO: 13500 - RNA, 27 nt, Artificial Sequence
  derived and/or modified sequence opt1 from anti-HIV_CDR
cagcaccgcagcuccuggccccugacc

SEQ ID NO: 13501 - RNA, 27 nt, Artificial Sequence
  derived and/or modified sequence opt1 from anti-HIV_CDR
cugcagcaccacagcuaccccuggacc

SEQ ID NO: 13502 - RNA, 27 nt, Artificial Sequence
  derived and/or modified sequence opt1 from anti-HIV_CDR
cagcaguacggcaccagccccgggacc

SEQ ID NO: 13503 - RNA, 27 nt, Artificial Sequence
  derived and/or modified sequence opt1 from anti-HIV_CDR
cagcaguacggcagcucccccaccacc

SEQ ID NO: 13504 - RNA, 27 nt, Artificial Sequence
  derived and/or modified sequence opt1 from anti-HIV_CDR
cagcaguacggcaccagccccaccacg

SEQ ID NO: 13505 - RNA, 27 nt, Artificial Sequence
  derived and/or modified sequence opt1 from anti-HIV_CDR
augcaggccacccacuggcccccgggc

SEQ ID NO: 13506 - RNA, 27 nt, Artificial Sequence
  derived and/or modified sequence opt1 from anti-HIV_CDR
cagcgcuacaaccgggaccccuacauc

SEQ ID NO: 13507 - RNA, 27 nt, Artificial Sequence
  derived and/or modified sequence opt1 from anti-HIV_CDR
cagcaguacgacaaccugccccucgcc

SEQ ID NO: 13508 - RNA, 27 nt, Artificial Sequence
  derived and/or modified sequence opt1 from anti-HIV_CDR
agcuccuacagcgccaccggcguggcc

SEQ ID NO: 13509 - RNA, 27 nt, Artificial Sequence
  derived and/or modified sequence opt1 from anti-HIV_CDR
cagcacuacggcaacagccgcuggacc

SEQ ID NO: 13510 - RNA, 27 nt, Artificial Sequence
  derived and/or modified sequence opt1 from anti-HIV_CDR
cagcaguacgagaccuaccccuggacc

SEQ ID NO: 13511 - RNA, 27 nt, Artificial Sequence
  derived and/or modified sequence opt1 from anti-HIV_CDR
cagcaguacggcagcucccccagcacc

SEQ ID NO: 13512 - RNA, 27 nt, Artificial Sequence
  derived and/or modified sequence opt1 from anti-HIV_CDR
cagcagagccagcgcaccccccacacc

SEQ ID NO: 13513 - RNA, 27 nt, Artificial Sequence
  derived and/or modified sequence opt1 from anti-HIV_CDR
cagcaguacgacauccugccccucacc

SEQ ID NO: 13514 - RNA, 27 nt, Artificial Sequence
  derived and/or modified sequence opt1 from anti-HIV_CDR
cagcagagcaacuccagccccuggacc

SEQ ID NO: 13515 - RNA, 27 nt, Artificial Sequence
  derived and/or modified sequence opt1 from anti-HIV_CDR
cagcagagcuacgacaccccccgcacc

SEQ ID NO: 13516 - RNA, 27 nt, Artificial Sequence
  derived and/or modified sequence opt1 from anti-HIV_CDR
cagcaguucggcagcucccccgggacc

SEQ ID NO: 13517 - RNA, 27 nt, Artificial Sequence
  derived and/or modified sequence opt1 from anti-HIV_CDR
caccaguacggcuccagcccccagacc

SEQ ID NO: 13518 - RNA, 27 nt, Artificial Sequence
  derived and/or modified sequence opt1 from anti-HIV_CDR
caccaguacggcagcagcccccagucc

SEQ ID NO: 13519 - RNA, 27 nt, Artificial Sequence
  derived and/or modified sequence opt1 from anti-HIV_CDR
cugcagcacaacagcuacccccucacc

SEQ ID NO: 13520 - RNA, 27 nt, Artificial Sequence
  derived and/or modified sequence opt1 from anti-HIV_CDR
cagcaguacaacgacuggcccaucacc

SEQ ID NO: 13521 - RNA, 27 nt, Artificial Sequence
  derived and/or modified sequence opt1 from anti-HIV_CDR
cagcagaccuucaccuuccccuacacg

SEQ ID NO: 13522 - RNA, 27 nt, Artificial Sequence
  derived and/or modified sequence opt1 from anti-HIV_CDR
cagcagagcuacaccuuccccuacauc

SEQ ID NO: 13523 - RNA, 27 nt, Artificial Sequence
  derived and/or modified sequence opt1 from anti-HIV_CDR
caguacuacggcagcucccccuacacc

SEQ ID NO: 13524 - RNA, 27 nt, Artificial Sequence
  derived and/or modified sequence opt1 from anti-HIV_CDR
cagcagagcuucggcaccccccgcacc

SEQ ID NO: 13525 - RNA, 27 nt, Artificial Sequence
  derived and/or modified sequence opt1 from anti-HIV_CDR
cagcaguacaacgacuggccccgcacc

SEQ ID NO: 13526 - RNA, 27 nt, Artificial Sequence
  derived and/or modified sequence opt1 from anti-HIV_CDR
cagcaguacggcuccagcccccgcacc

SEQ ID NO: 13527 - RNA, 27 nt, Artificial Sequence
  derived and/or modified sequence opt1 from anti-HIV_CDR
cugcagcacaaccgcuaccccuggacc

SEQ ID NO: 13528 - RNA, 27 nt, Artificial Sequence
  derived and/or modified sequence opt1 from anti-HIV_CDR
cugcagcacaacaacuaccccuggacc

SEQ ID NO: 13529 - RNA, 27 nt, Artificial Sequence
  derived and/or modified sequence opt1 from anti-HIV_CDR
cugcaguacagcaccuacccccucacc

SEQ ID NO: 13530 - RNA, 27 nt, Artificial Sequence
  derived and/or modified sequence opt1 from anti-HIV_CDR
cugcaguacaacgccuacccccucacc

SEQ ID NO: 13531 - RNA, 27 nt, Artificial Sequence
  derived and/or modified sequence opt1 from anti-HIV_CDR
cagcaguacgacagcgcccccgugacc

SEQ ID NO: 13532 - RNA, 27 nt, Artificial Sequence
  derived and/or modified sequence opt1 from anti-HIV_CDR
cagcagaccuacaccuuccccuacagc

SEQ ID NO: 13533 - RNA, 27 nt, Artificial Sequence
  derived and/or modified sequence opt1 from anti-HIV_CDR
ggcuacgacaacagcgggcccgacuac

SEQ ID NO: 13534 - RNA, 27 nt, Artificial Sequence
  derived and/or modified sequence opt1 from anti-HIV_CDR
cagcaguacaacaacuggcccccggcc

SEQ ID NO: 13535 - RNA, 27 nt, Artificial Sequence
  derived and/or modified sequence opt1 from anti-HIV_CDR
caccaguacgcccugagccccuggacc

SEQ ID NO: 13536 - RNA, 27 nt, Artificial Sequence
  derived and/or modified sequence opt1 from anti-HIV_CDR
cagaaguacgacaccgaccccaugacc

SEQ ID NO: 13537 - RNA, 27 nt, Artificial Sequence
  derived and/or modified sequence opt1 from anti-HIV_CDR
cagcaguacaacuacuaccccaucacc

SEQ ID NO: 13538 - RNA, 27 nt, Artificial Sequence
  derived and/or modified sequence opt1 from anti-HIV_CDR
cagcagaccuucaccgaccccgugacg

SEQ ID NO: 13539 - RNA, 27 nt, Artificial Sequence
  derived and/or modified sequence opt1 from anti-HIV_CDR
gccgccugggacgacagccugcacgug

SEQ ID NO: 13540 - RNA, 27 nt, Artificial Sequence
  derived and/or modified sequence opt1 from anti-HIV_CDR
cagcaguacgccagcucccccuucacc

SEQ ID NO: 13541 - RNA, 27 nt, Artificial Sequence
  derived and/or modified sequence opt1 from anti-HIV_CDR
cagcagagcuccagcacccccuucacc

SEQ ID NO: 13542 - RNA, 27 nt, Artificial Sequence
  derived and/or modified sequence opt1 from anti-HIV_CDR
cagcagcgcagcaacugggccaucacc

SEQ ID NO: 13543 - RNA, 27 nt, Artificial Sequence
  derived and/or modified sequence opt1 from anti-HIV_CDR
cagcaguacggcagcucccccuucacc

SEQ ID NO: 13544 - RNA, 27 nt, Artificial Sequence
  derived and/or modified sequence opt1 from anti-HIV_CDR
cagaaguacaacggcgcccccuggacc

SEQ ID NO: 13545 - RNA, 27 nt, Artificial Sequence
  derived and/or modified sequence opt1 from anti-HIV_CDR
cagaaguacaacaacgcccccuggacc

SEQ ID NO: 13546 - RNA, 27 nt, Artificial Sequence
  derived and/or modified sequence opt1 from anti-HIV_CDR
cagcagcgcgugaacuggcccccgaac

SEQ ID NO: 13547 - RNA, 27 nt, Artificial Sequence
  derived and/or modified sequence opt1 from anti-HIV_CDR
cagcagcgcggccacuggccccugacc

SEQ ID NO: 13548 - RNA, 27 nt, Artificial Sequence
  derived and/or modified sequence opt1 from anti-HIV_CDR
cagcaguaccgcuacagcgugaucauc

SEQ ID NO: 13549 - RNA, 27 nt, Artificial Sequence
  derived and/or modified sequence opt1 from anti-HIV_CDR
cagcagagcggcaccucccugcucacc

SEQ ID NO: 13550 - RNA, 27 nt, Artificial Sequence
  derived and/or modified sequence opt1 from anti-HIV_CDR
augaagucccagcacagcccccgcacc

SEQ ID NO: 13551 - RNA, 27 nt, Artificial Sequence
  derived and/or modified sequence opt1 from anti-HIV_CDR
augcagccccugcagaccccguacacc

SEQ ID NO: 13552 - RNA, 27 nt, Artificial Sequence
  derived and/or modified sequence opt1 from anti-HIV_CDR
cagcaguacaccgccuaccccuggacc

SEQ ID NO: 13553 - RNA, 27 nt, Artificial Sequence
  derived and/or modified sequence opt1 from anti-HIV_CDR
cugcagaaccacaacuacccccgcacc

SEQ ID NO: 13554 - RNA, 27 nt, Artificial Sequence
  derived and/or modified sequence opt1 from anti-HIV_CDR
cugcagacccacagcuacccccgcacc

SEQ ID NO: 13555 - RNA, 30 nt, Artificial Sequence
  derived and/or modified sequence opt1 from anti-HIV_CDR
gccgccugggacgacagcuucgacuacgug

SEQ ID NO: 13556 - RNA, 30 nt, Artificial Sequence
  derived and/or modified sequence opt1 from anti-HIV_CDR
cagcacagcuucggcuccccgcccuggacc

SEQ ID NO: 13557 - RNA, 30 nt, Artificial Sequence
  derived and/or modified sequence opt1 from anti-HIV_CDR
agcuccuucacccccaccaacacgcuggug

SEQ ID NO: 13558 - RNA, 30 nt, Artificial Sequence
  derived and/or modified sequence opt1 from anti-HIV_CDR
cagcaguacggcacccugcacccccgcacc

SEQ ID NO: 13559 - RNA, 30 nt, Artificial Sequence
  derived and/or modified sequence opt1 from anti-HIV_CDR
cagcaguacaacaacuggcccccgaucacc

SEQ ID NO: 13560 - RNA, 30 nt, Artificial Sequence
  derived and/or modified sequence opt1 from anti-HIV_CDR
cagcaguacuaccaguggcugagcuacacc

SEQ ID NO: 13561 - RNA, 30 nt, Artificial Sequence
  derived and/or modified sequence opt1 from anti-HIV_CDR
cagcagcgcgccaacuggcggcugcucacc

SEQ ID NO: 13562 - RNA, 30 nt, Artificial Sequence
  derived and/or modified sequence opt1 from anti-HIV_CDR
cgccacagcgacuacugcgaccuggacgug

SEQ ID NO: 13563 - RNA, 30 nt, Artificial Sequence
  derived and/or modified sequence opt1 from anti-HIV_CDR
cgccggagcgacuacugcgacuucgacgug

SEQ ID NO: 13564 - RNA, 30 nt, Artificial Sequence
  derived and/or modified sequence opt1 from anti-HIV_CDR
cgccacaccgacuacugcgacuucgacgug

SEQ ID NO: 13565 - RNA, 30 nt, Artificial Sequence
  derived and/or modified sequence opt1 from anti-HIV_CDR
cagcgcagcgacuacugggacuucgacgug

SEQ ID NO: 13566 - RNA, 30 nt, Artificial Sequence
  derived and/or modified sequence opt1 from anti-HIV_CDR
cgccacagcgacuacugcgacuucgacauc

SEQ ID NO: 13567 - RNA, 30 nt, Artificial Sequence
  derived and/or modified sequence opt1 from anti-HIV_CDR
ugcgagguggacgccgacgagaccaucacc

SEQ ID NO: 13568 - RNA, 30 nt, Artificial Sequence
  derived and/or modified sequence opt1 from anti-HIV_CDR
ugcgagguggacgccgaggagaccaucauc

SEQ ID NO: 13569 - RNA, 30 nt, Artificial Sequence
  derived and/or modified sequence opt1 from anti-HIV_CDR
cagcgcagcgacuucugggacuucgacgug

SEQ ID NO: 13570 - RNA, 30 nt, Artificial Sequence
  derived and/or modified sequence opt1 from anti-HIV_CDR
cgccacagcgacuacugcgacuucgacgug

SEQ ID NO: 13571 - RNA, 30 nt, Artificial Sequence
  derived and/or modified sequence opt1 from anti-HIV_CDR
ugcagcuacgccggcgggcgcaccgugguc

SEQ ID NO: 13572 - RNA, 30 nt, Artificial Sequence
  derived and/or modified sequence opt1 from anti-HIV_CDR
gccgccugggacgacagccuggacuacgug

SEQ ID NO: 13573 - RNA, 30 nt, Artificial Sequence
  derived and/or modified sequence opt1 from anti-HIV_CDR
cagcagcgcagcaacuggccccggcugacc

SEQ ID NO: 13574 - RNA, 30 nt, Artificial Sequence
  derived and/or modified sequence opt1 from anti-HIV_CDR
cagcaguacaacaacuggcccccguucacc

SEQ ID NO: 13575 - RNA, 30 nt, Artificial Sequence
  derived and/or modified sequence opt1 from anti-HIV_CDR
augcagggcaccuacuggcccccgcugacc

SEQ ID NO: 13576 - RNA, 30 nt, Artificial Sequence
  derived and/or modified sequence opt1 from anti-HIV_CDR
cagcaguacggcagcucccugcucuacacc

SEQ ID NO: 13577 - RNA, 30 nt, Artificial Sequence
  derived and/or modified sequence opt1 from anti-HIV_CDR
cagcagagcuucggcaucccgcccuggacc

SEQ ID NO: 13578 - RNA, 30 nt, Artificial Sequence
  derived and/or modified sequence opt1 from anti-HIV_CDR
ugcagcuacgccggcuccuacagcuacgug

SEQ ID NO: 13579 - RNA, 30 nt, Artificial Sequence
  derived and/or modified sequence opt1 from anti-HIV_CDR
uacagcuacgccggcaacucccugggggug

SEQ ID NO: 13580 - RNA, 30 nt, Artificial Sequence
  derived and/or modified sequence opt1 from anti-HIV_CDR
uccuccuacaccaucagcagcccccgcgug

SEQ ID NO: 13581 - RNA, 30 nt, Artificial Sequence
  derived and/or modified sequence opt1 from anti-HIV_CDR
caggagugggagcugcagcccuucgacuac

SEQ ID NO: 13582 - RNA, 30 nt, Artificial Sequence
  derived and/or modified sequence opt1 from anti-HIV_CDR
cugauccccgugagcggcgccuucgacguc

SEQ ID NO: 13583 - RNA, 30 nt, Artificial Sequence
  derived and/or modified sequence opt1 from anti-HIV_CDR
gaccgcgacuacgacgaggacuucgacuuc

SEQ ID NO: 13584 - RNA, 30 nt, Artificial Sequence
  derived and/or modified sequence opt1 from anti-HIV_CDR
caggaguacggccgcagcccgcccuucccc

SEQ ID NO: 13585 - RNA, 30 nt, Artificial Sequence
  derived and/or modified sequence opt1 from anti-HIV_CDR
acccuggacggcaacuuccacugggacuuc

SEQ ID NO: 13586 - RNA, 30 nt, Artificial Sequence
  derived and/or modified sequence opt1 from anti-HIV_CDR
uucacccagcgccagggcggguucgacuac

SEQ ID NO: 13587 - RNA, 30 nt, Artificial Sequence
  derived and/or modified sequence opt1 from anti-HIV_CDR
cagcaguacuacaaguggcccccgaucacc

SEQ ID NO: 13588 - RNA, 30 nt, Artificial Sequence
  derived and/or modified sequence opt1 from anti-HIV_CDR
cagcaguacggcagcuccgcccccuacacc

SEQ ID NO: 13589 - RNA, 30 nt, Artificial Sequence
  derived and/or modified sequence opt1 from anti-HIV_CDR
cagcagcugaacagcgacccgcccuggacc

SEQ ID NO: 13590 - RNA, 30 nt, Artificial Sequence
  derived and/or modified sequence opt1 from anti-HIV_CDR
cagcaccacggcagcucccccaccuggacc

SEQ ID NO: 13591 - RNA, 30 nt, Artificial Sequence
  derived and/or modified sequence opt1 from anti-HIV_CDR
cagcaguacaagaaguggcccccguggacc

SEQ ID NO: 13592 - RNA, 30 nt, Artificial Sequence
  derived and/or modified sequence opt1 from anti-HIV_CDR
cagcaguacggcuucagccugcccgugacc

SEQ ID NO: 13593 - RNA, 30 nt, Artificial Sequence
  derived and/or modified sequence opt1 from anti-HIV_CDR
cagagcuacaacggcgacccgcccgugacc

SEQ ID NO: 13594 - RNA, 30 nt, Artificial Sequence
  derived and/or modified sequence opt1 from anti-HIV_CDR
cagcaguacggcagcucccgccgguggacc

SEQ ID NO: 13595 - RNA, 30 nt, Artificial Sequence
  derived and/or modified sequence opt1 from anti-HIV_CDR
cagcaguucaacagcuacccgccccugacc

SEQ ID NO: 13596 - RNA, 30 nt, Artificial Sequence
  derived and/or modified sequence opt1 from anti-HIV_CDR
cgcgagggcagccagggggccuucgacauc

SEQ ID NO: 13597 - RNA, 30 nt, Artificial Sequence
  derived and/or modified sequence opt1 from anti-HIV_CDR
ggcgacagcgggcccaccggcuucgacuac

SEQ ID NO: 13598 - RNA, 30 nt, Artificial Sequence
  derived and/or modified sequence opt1 from anti-HIV_CDR
gugcgccggggcagcuccuaccccgacuac

SEQ ID NO: 13599 - RNA, 30 nt, Artificial Sequence
  derived and/or modified sequence opt1 from anti-HIV_CDR
agcgccuacuaccgcaacugguucgacucc

SEQ ID NO: 13600 - RNA, 30 nt, Artificial Sequence
  derived and/or modified sequence opt1 from anti-HIV_CDR
cagagcuacgacuccagcguguccgucgug

SEQ ID NO: 13601 - RNA, 30 nt, Artificial Sequence
  derived and/or modified sequence opt1 from anti-HIV_CDR
agcuccuacaccagcucccugacccucgug

SEQ ID NO: 13602 - RNA, 30 nt, Artificial Sequence
  derived and/or modified sequence opt1 from anti-HIV_CDR
uacgagggcaagcgcagcgggauggacgug

SEQ ID NO: 13603 - RNA, 30 nt, Artificial Sequence
  derived and/or modified sequence opt1 from anti-HIV_CDR
cagcaguacggcagcucccccgaguacacc

SEQ ID NO: 13604 - RNA, 30 nt, Artificial Sequence
  derived and/or modified sequence opt1 from anti-HIV_CDR
caguacuacgaccaccgccccgccaucgcc

SEQ ID NO: 13605 - RNA, 30 nt, Artificial Sequence
  derived and/or modified sequence opt1 from anti-HIV_CDR
cagcaguacgacaaccugccccgcgugacc

SEQ ID NO: 13606 - RNA, 30 nt, Artificial Sequence
  derived and/or modified sequence opt1 from anti-HIV_CDR
ggcgccuacaccaccacgagcacccuggug

SEQ ID NO: 13607 - RNA, 30 nt, Artificial Sequence
  derived and/or modified sequence opt1 from anti-HIV_CDR
cagcaguacaaguccuacagcccccugacc

SEQ ID NO: 13608 - RNA, 30 nt, Artificial Sequence
  derived and/or modified sequence opt1 from anti-HIV_CDR
cagcagagcuacaacacccgcccccugacc

SEQ ID NO: 13609 - RNA, 30 nt, Artificial Sequence
  derived and/or modified sequence opt1 from anti-HIV_CDR
cagcaguacggcgggagcccgcccgacacc

SEQ ID NO: 13610 - RNA, 30 nt, Artificial Sequence
  derived and/or modified sequence opt1 from anti-HIV_CDR
ugcagcuacaccuccagcgccaccgugguc

SEQ ID NO: 13611 - RNA, 30 nt, Artificial Sequence
  derived and/or modified sequence opt1 from anti-HIV_CDR
ugcagccacaccuccagcgacacccuggug

SEQ ID NO: 13612 - RNA, 30 nt, Artificial Sequence
  derived and/or modified sequence opt1 from anti-HIV_CDR
cagcacuacggcaacagcccccgcgugacc

SEQ ID NO: 13613 - RNA, 30 nt, Artificial Sequence
  derived and/or modified sequence opt1 from anti-HIV_CDR
gacgccuucgugagcuccgccauggacguc

SEQ ID NO: 13614 - RNA, 30 nt, Artificial Sequence
  derived and/or modified sequence opt1 from anti-HIV_CDR
cugcgcgccaccacccccggcuucgacuac

SEQ ID NO: 13615 - RNA, 30 nt, Artificial Sequence
  derived and/or modified sequence opt1 from anti-HIV_CDR
cugcgcgccaccauccccggcuucgacuac

SEQ ID NO: 13616 - RNA, 30 nt, Artificial Sequence
  derived and/or modified sequence opt1 from anti-HIV_CDR
cugcgcgccaccaucgccggcuucgacuac

SEQ ID NO: 13617 - RNA, 30 nt, Artificial Sequence
  derived and/or modified sequence opt1 from anti-HIV_CDR
ugcagcuacgccggcuccuacaucugggug

SEQ ID NO: 13618 - RNA, 30 nt, Artificial Sequence
  derived and/or modified sequence opt1 from anti-HIV_CDR
ugcagcuacgccggcaccuacuccuacgug

SEQ ID NO: 13619 - RNA, 30 nt, Artificial Sequence
  derived and/or modified sequence opt1 from anti-HIV_CDR
agcuccuacgccggcagcaacaacuucgug

SEQ ID NO: 13620 - RNA, 30 nt, Artificial Sequence
  derived and/or modified sequence opt1 from anti-HIV_CDR
ggcagcuucaccaccucccugacgcucgug

SEQ ID NO: 13621 - RNA, 30 nt, Artificial Sequence
  derived and/or modified sequence opt1 from anti-HIV_CDR
cagcaguacgccaccagcucccuguacacc

SEQ ID NO: 13622 - RNA, 30 nt, Artificial Sequence
  derived and/or modified sequence opt1 from anti-HIV_CDR
cagugguacggcacccugcacccccgcacc

SEQ ID NO: 13623 - RNA, 30 nt, Artificial Sequence
  derived and/or modified sequence opt1 from anti-HIV_CDR
agcuccuacagcuccaccaacaccuacgug

SEQ ID NO: 13624 - RNA, 30 nt, Artificial Sequence
  derived and/or modified sequence opt1 from anti-HIV_CDR
accuucaucaccgccagcugguucgacucc

SEQ ID NO: 13625 - RNA, 30 nt, Artificial Sequence
  derived and/or modified sequence opt1 from anti-HIV_CDR
accggcgggcugcuccgcuuccccgaggug

SEQ ID NO: 13626 - RNA, 30 nt, Artificial Sequence
  derived and/or modified sequence opt1 from anti-HIV_CDR
ugcagcuacgccggcuccuacaccuacgug

SEQ ID NO: 13627 - RNA, 30 nt, Artificial Sequence
  derived and/or modified sequence opt1 from anti-HIV_CDR
cagcagcgcuacagcuggcccucccugacc

SEQ ID NO: 13628 - RNA, 30 nt, Artificial Sequence
  derived and/or modified sequence opt1 from anti-HIV_CDR
cugcagugcggcagcuccccgcccuacacc

SEQ ID NO: 13629 - RNA, 30 nt, Artificial Sequence
  derived and/or modified sequence opt1 from anti-HIV_CDR
agcuccuacgccggcaccaaccacugggug

SEQ ID NO: 13630 - RNA, 30 nt, Artificial Sequence
  derived and/or modified sequence opt1 from anti-HIV_CDR
agcuccuacgccgccaccaaccacugggug

SEQ ID NO: 13631 - RNA, 30 nt, Artificial Sequence
  derived and/or modified sequence opt1 from anti-HIV_CDR
caguacuacggcaccagcccgcccuccacc

SEQ ID NO: 13632 - RNA, 30 nt, Artificial Sequence
  derived and/or modified sequence opt1 from anti-HIV_CDR
caguacuacggcagcuccccgcccagcacc

SEQ ID NO: 13633 - RNA, 30 nt, Artificial Sequence
  derived and/or modified sequence opt1 from anti-HIV_CDR
caggaguucggccgcgccccgcccuacccc

SEQ ID NO: 13634 - RNA, 30 nt, Artificial Sequence
  derived and/or modified sequence opt1 from anti-HIV_CDR
caggaguacggccgcagcccgcccuacccc

SEQ ID NO: 13635 - RNA, 30 nt, Artificial Sequence
  derived and/or modified sequence opt1 from anti-HIV_CDR
caggaguacggccgcgccccgcccuacccc

SEQ ID NO: 13636 - RNA, 30 nt, Artificial Sequence
  derived and/or modified sequence opt1 from anti-HIV_CDR
cacaucgccgugggcgggagcgaggagcac

SEQ ID NO: 13637 - RNA, 30 nt, Artificial Sequence
  derived and/or modified sequence opt1 from anti-HIV_CDR
cacaucgccgugggcgggagcgaggaccac

SEQ ID NO: 13638 - RNA, 30 nt, Artificial Sequence
  derived and/or modified sequence opt1 from anti-HIV_CDR
cacaucgccgugggcgggcgcgaggaggag

SEQ ID NO: 13639 - RNA, 33 nt, Artificial Sequence
  derived and/or modified sequence opt1 from anti-HIV_CDR
ggcgagaagucccgcgggagccgggccgugcag

SEQ ID NO: 13640 - RNA, 33 nt, Artificial Sequence
  derived and/or modified sequence opt1 from anti-HIV_CDR
ggcgagaaguccuucgccagccgcgccgugcag

SEQ ID NO: 13641 - RNA, 33 nt, Artificial Sequence
  derived and/or modified sequence opt1 from anti-HIV_CDR
ggccgccaggcccuggggagccgggccgugcag

SEQ ID NO: 13642 - RNA, 33 nt, Artificial Sequence
  derived and/or modified sequence opt1 from anti-HIV_CDR
ggcgaggagagccuggggucccgcagcgugauc

SEQ ID NO: 13643 - RNA, 33 nt, Artificial Sequence
  derived and/or modified sequence opt1 from anti-HIV_CDR
ggcgagaagucccuggggagccgcgccgugcag

SEQ ID NO: 13644 - RNA, 33 nt, Artificial Sequence
  derived and/or modified sequence opt1 from anti-HIV_CDR
ggcaaggagagcaucgggucccgcgccgugcag

SEQ ID NO: 13645 - RNA, 33 nt, Artificial Sequence
  derived and/or modified sequence opt1 from anti-HIV_CDR
ggcgggaacaacaucggcagcaaguccgugcac

SEQ ID NO: 13646 - RNA, 33 nt, Artificial Sequence
  derived and/or modified sequence opt1 from anti-HIV_CDR
ggcgagaaguccaucgggagccgcgccgugcag

SEQ ID NO: 13647 - RNA, 33 nt, Artificial Sequence
  derived and/or modified sequence opt1 from anti-HIV_CDR
aaggccagccaggacguguccaccgccgucgcg

SEQ ID NO: 13648 - RNA, 33 nt, Artificial Sequence
  derived and/or modified sequence opt1 from anti-HIV_CDR
ggcagccgcaaccugucccaccggcuccugagc

SEQ ID NO: 13649 - RNA, 33 nt, Artificial Sequence
  derived and/or modified sequence opt1 from anti-HIV_CDR
ggcaccuacgacagccagggguccacccgccug

SEQ ID NO: 13650 - RNA, 33 nt, Artificial Sequence
  derived and/or modified sequence opt1 from anti-HIV_CDR
cagcagcgcaccaucuggcccccgggcugcagc

SEQ ID NO: 13651 - RNA, 33 nt, Artificial Sequence
  derived and/or modified sequence opt1 from anti-HIV_CDR
ggcaccugggacagcucccugagcgccgugcuc

SEQ ID NO: 13652 - RNA, 33 nt, Artificial Sequence
  derived and/or modified sequence opt1 from anti-HIV_CDR
gccagcugggacaacucccugagcggccccgug

SEQ ID NO: 13653 - RNA, 33 nt, Artificial Sequence
  derived and/or modified sequence opt1 from anti-HIV_CDR
gccagcugggacgacucccugagcggcugggug

SEQ ID NO: 13654 - RNA, 33 nt, Artificial Sequence
  derived and/or modified sequence opt1 from anti-HIV_CDR
cugcuccugcccuacuacggcgggccguggauc

SEQ ID NO: 13655 - RNA, 33 nt, Artificial Sequence
  derived and/or modified sequence opt1 from anti-HIV_CDR
cagcaccgcaccaacuggcccccgagcaucacc

SEQ ID NO: 13656 - RNA, 33 nt, Artificial Sequence
  derived and/or modified sequence opt1 from anti-HIV_CDR
cagagcuacgaccgcucccugcggggcagcgug

SEQ ID NO: 13657 - RNA, 33 nt, Artificial Sequence
  derived and/or modified sequence opt1 from anti-HIV_CDR
agcuccggcaacuacgacuucgccuucgacauc

SEQ ID NO: 13658 - RNA, 33 nt, Artificial Sequence
  derived and/or modified sequence opt1 from anti-HIV_CDR
agcuccggcaacuacgacuucgccuacgacauc

SEQ ID NO: 13659 - RNA, 33 nt, Artificial Sequence
  derived and/or modified sequence opt1 from anti-HIV_CDR
agcuccggcaacuucgaguucgccuucgagauc

SEQ ID NO: 13660 - RNA, 33 nt, Artificial Sequence
  derived and/or modified sequence opt1 from anti-HIV_CDR
gccaccuacgacagccacggcuccauccgccug

SEQ ID NO: 13661 - RNA, 33 nt, Artificial Sequence
  derived and/or modified sequence opt1 from anti-HIV_CDR
ggcaccuacgacaccagccugucccuccgccug

SEQ ID NO: 13662 - RNA, 33 nt, Artificial Sequence
  derived and/or modified sequence opt1 from anti-HIV_CDR
gccgccuucgacagcgcgcugucccucccccug

SEQ ID NO: 13663 - RNA, 33 nt, Artificial Sequence
  derived and/or modified sequence opt1 from anti-HIV_CDR
gccaccuacgacagcgacggcuccauccgccug

SEQ ID NO: 13664 - RNA, 33 nt, Artificial Sequence
  derived and/or modified sequence opt1 from anti-HIV_CDR
gccaccuacgacagcggcugguccauccgccug

SEQ ID NO: 13665 - RNA, 33 nt, Artificial Sequence
  derived and/or modified sequence opt1 from anti-HIV_CDR
gccaccuacgacaccggccugagccuccgccug

SEQ ID NO: 13666 - RNA, 33 nt, Artificial Sequence
  derived and/or modified sequence opt1 from anti-HIV_CDR
gccgccuacgacagcacccugucccuccgccug

SEQ ID NO: 13667 - RNA, 33 nt, Artificial Sequence
  derived and/or modified sequence opt1 from anti-HIV_CDR
gccgccuacgacagcgcggugucccugcccguc

SEQ ID NO: 13668 - RNA, 33 nt, Artificial Sequence
  derived and/or modified sequence opt1 from anti-HIV_CDR
gccaccuacgacaccgaccugagccuccgccug

SEQ ID NO: 13669 - RNA, 33 nt, Artificial Sequence
  derived and/or modified sequence opt1 from anti-HIV_CDR
gccgccuacgacagcucccugagccuccgccug

SEQ ID NO: 13670 - RNA, 33 nt, Artificial Sequence
  derived and/or modified sequence opt1 from anti-HIV_CDR
gccgccuacgacagcaccuucucccugcccgug

SEQ ID NO: 13671 - RNA, 33 nt, Artificial Sequence
  derived and/or modified sequence opt1 from anti-HIV_CDR
gccaccuacgacagccagggcuccacccgccug

SEQ ID NO: 13672 - RNA, 33 nt, Artificial Sequence
  derived and/or modified sequence opt1 from anti-HIV_CDR
gccaccuacgacagccagcgcuccauccggcug

SEQ ID NO: 13673 - RNA, 33 nt, Artificial Sequence
  derived and/or modified sequence opt1 from anti-HIV_CDR
gccguguacgacagcucccugagccucggccug

SEQ ID NO: 13674 - RNA, 33 nt, Artificial Sequence
  derived and/or modified sequence opt1 from anti-HIV_CDR
cagcaccgcagcaucuggccccugaugugcacc

SEQ ID NO: 13675 - RNA, 33 nt, Artificial Sequence
  derived and/or modified sequence opt1 from anti-HIV_CDR
cugcagcccguguacaucuuccgcggcaccugg

SEQ ID NO: 13676 - RNA, 33 nt, Artificial Sequence
  derived and/or modified sequence opt1 from anti-HIV_CDR
ugcgaggucgacgccgacgagaccgugaccugc

SEQ ID NO: 13677 - RNA, 33 nt, Artificial Sequence
  derived and/or modified sequence opt1 from anti-HIV_CDR
ugcgagguggacgccgaggucaccaugaccgug

SEQ ID NO: 13678 - RNA, 33 nt, Artificial Sequence
  derived and/or modified sequence opt1 from anti-HIV_CDR
agcuccuacgccgacaccaacgacuucggcgug

SEQ ID NO: 13679 - RNA, 33 nt, Artificial Sequence
  derived and/or modified sequence opt1 from anti-HIV_CDR
ugcagcuucaccuacgugaaccccaccuaccug

SEQ ID NO: 13680 - RNA, 33 nt, Artificial Sequence
  derived and/or modified sequence opt1 from anti-HIV_CDR
ggcaccugggacgggagccugaccacgggcgug

SEQ ID NO: 13681 - RNA, 33 nt, Artificial Sequence
  derived and/or modified sequence opt1 from anti-HIV_CDR
cagagcuacgacaacucccugagcggcugggug

SEQ ID NO: 13682 - RNA, 33 nt, Artificial Sequence
  derived and/or modified sequence opt1 from anti-HIV_CDR
cagcaguacuacagcaucccgcccuggaccuuc

SEQ ID NO: 13683 - RNA, 33 nt, Artificial Sequence
  derived and/or modified sequence opt1 from anti-HIV_CDR
augcagggcaccuacuggcccccgagcaucacc

SEQ ID NO: 13684 - RNA, 33 nt, Artificial Sequence
  derived and/or modified sequence opt1 from anti-HIV_CDR
cagagcuacgacuccagccugggcguggagguc

SEQ ID NO: 13685 - RNA, 33 nt, Artificial Sequence
  derived and/or modified sequence opt1 from anti-HIV_CDR
caggugugggacagcggccgcgacuccuggguc

SEQ ID NO: 13686 - RNA, 33 nt, Artificial Sequence
  derived and/or modified sequence opt1 from anti-HIV_CDR
cagagcuacgacuccagccuguccggcugggug

SEQ ID NO: 13687 - RNA, 33 nt, Artificial Sequence
  derived and/or modified sequence opt1 from anti-HIV_CDR
ggcagcugggacgggucccugaacgccggcgug

SEQ ID NO: 13688 - RNA, 33 nt, Artificial Sequence
  derived and/or modified sequence opt1 from anti-HIV_CDR
cugagcgccgacuccagcuccaccuaccaggug

SEQ ID NO: 13689 - RNA, 33 nt, Artificial Sequence
  derived and/or modified sequence opt1 from anti-HIV_CDR
ugcagcuacgccggccgcgacaccuccugggug

SEQ ID NO: 13690 - RNA, 33 nt, Artificial Sequence
  derived and/or modified sequence opt1 from anti-HIV_CDR
cagcagcgcagcaacuggcccccgggccugacc

SEQ ID NO: 13691 - RNA, 33 nt, Artificial Sequence
  derived and/or modified sequence opt1 from anti-HIV_CDR
aagggccgcggguacggcuacugguucgacagc

SEQ ID NO: 13692 - RNA, 33 nt, Artificial Sequence
  derived and/or modified sequence opt1 from anti-HIV_CDR
gagauggccgccaccagcgacgcguucgacauc

SEQ ID NO: 13693 - RNA, 33 nt, Artificial Sequence
  derived and/or modified sequence opt1 from anti-HIV_CDR
agcaucuacuccaccggccccgccccgguguac

SEQ ID NO: 13694 - RNA, 33 nt, Artificial Sequence
  derived and/or modified sequence opt1 from anti-HIV_CDR
cgcggcagccugcucaucaaguacuucgacuac

SEQ ID NO: 13695 - RNA, 33 nt, Artificial Sequence
  derived and/or modified sequence opt1 from anti-HIV_CDR
cagcaguacgacaaccugcccccgcgcgugacc

SEQ ID NO: 13696 - RNA, 33 nt, Artificial Sequence
  derived and/or modified sequence opt1 from anti-HIV_CDR
gacgugcgccuggucgccgugcccggcgccgac

SEQ ID NO: 13697 - RNA, 33 nt, Artificial Sequence
  derived and/or modified sequence opt1 from anti-HIV_CDR
cagcagcgcaccaccuggcccccggaguacacg

SEQ ID NO: 13698 - RNA, 33 nt, Artificial Sequence
  derived and/or modified sequence opt1 from anti-HIV_CDR
gccgccugggacgacagccugaacggcugggug

SEQ ID NO: 13699 - RNA, 33 nt, Artificial Sequence
  derived and/or modified sequence opt1 from anti-HIV_CDR
cgccggcgcagcgccuggucccccuucgacagc

SEQ ID NO: 13700 - RNA, 33 nt, Artificial Sequence
  derived and/or modified sequence opt1 from anti-HIV_CDR
gccaccugggacagcucccugcgcaccgcccuc

SEQ ID NO: 13701 - RNA, 33 nt, Artificial Sequence
  derived and/or modified sequence opt1 from anti-HIV_CDR
ggcaccugggacagcucccugcgcgccgcccuc

SEQ ID NO: 13702 - RNA, 33 nt, Artificial Sequence
  derived and/or modified sequence opt1 from anti-HIV_CDR
cagcagcgcagcaucuggcccccgucccugacc

SEQ ID NO: 13703 - RNA, 33 nt, Artificial Sequence
  derived and/or modified sequence opt1 from anti-HIV_CDR
gaguuccagaccagcggcgugguccgcgagggg

SEQ ID NO: 13704 - RNA, 33 nt, Artificial Sequence
  derived and/or modified sequence opt1 from anti-HIV_CDR
cacaucggcgccgggggccccuacagcgaguac

SEQ ID NO: 13705 - RNA, 33 nt, Artificial Sequence
  derived and/or modified sequence opt1 from anti-HIV_CDR
cgcggccacagcuucaccucccccuucgacagc

SEQ ID NO: 13706 - RNA, 33 nt, Artificial Sequence
  derived and/or modified sequence opt1 from anti-HIV_CDR
cagcaccugaacagcuacccccgcauguacacc

SEQ ID NO: 13707 - RNA, 33 nt, Artificial Sequence
  derived and/or modified sequence opt1 from anti-HIV_CDR
cagcagcgcagcaacuggcccccgaagaucacc

SEQ ID NO: 13708 - RNA, 33 nt, Artificial Sequence
  derived and/or modified sequence opt1 from anti-HIV_CDR
gccgccugggacgacagccugggcggggugguc

SEQ ID NO: 13709 - RNA, 33 nt, Artificial Sequence
  derived and/or modified sequence opt1 from anti-HIV_CDR
ggcaccugggacagcucccugagcgccgugguc

SEQ ID NO: 13710 - RNA, 33 nt, Artificial Sequence
  derived and/or modified sequence opt1 from anti-HIV_CDR
cagcagcgcgccaacuggcccccgggcgggacc

SEQ ID NO: 13711 - RNA, 33 nt, Artificial Sequence
  derived and/or modified sequence opt1 from anti-HIV_CDR
ggcgggggcuacccccgcgggaacauggacgug

SEQ ID NO: 13712 - RNA, 33 nt, Artificial Sequence
  derived and/or modified sequence opt1 from anti-HIV_CDR
cugcuccugcuguacuacggcgggcccuggauc

SEQ ID NO: 13713 - RNA, 33 nt, Artificial Sequence
  derived and/or modified sequence opt1 from anti-HIV_CDR
cagcagcgcggcaucuggccccugcagaucacc

SEQ ID NO: 13714 - RNA, 33 nt, Artificial Sequence
  derived and/or modified sequence opt1 from anti-HIV_CDR
cgcagccccggcgggggcuacgccuucgacauc

SEQ ID NO: 13715 - RNA, 33 nt, Artificial Sequence
  derived and/or modified sequence opt1 from anti-HIV_CDR
agcggccccgggcugcuccgcggcuucgacuac

SEQ ID NO: 13716 - RNA, 33 nt, Artificial Sequence
  derived and/or modified sequence opt1 from anti-HIV_CDR
cagcagcgcaccacccggcccccggaguacacg

SEQ ID NO: 13717 - RNA, 33 nt, Artificial Sequence
  derived and/or modified sequence opt1 from anti-HIV_CDR
cagcagcgcaccacccggcccccggacuacacg

SEQ ID NO: 13718 - RNA, 33 nt, Artificial Sequence
  derived and/or modified sequence opt1 from anti-HIV_CDR
cagggccgcaccacccggcccccggacuacacg

SEQ ID NO: 13719 - RNA, 33 nt, Artificial Sequence
  derived and/or modified sequence opt1 from anti-HIV_CDR
cagcagcgcagcaccacgcccccggaguacacc

SEQ ID NO: 13720 - RNA, 33 nt, Artificial Sequence
  derived and/or modified sequence opt1 from anti-HIV_CDR
cagcagcgcaccagcuggccccuggcccucucc

SEQ ID NO: 13721 - RNA, 33 nt, Artificial Sequence
  derived and/or modified sequence opt1 from anti-HIV_CDR
cgcggccacagcuucucccugcccuucgacagc

SEQ ID NO: 13722 - RNA, 36 nt, Artificial Sequence
  derived and/or modified sequence opt1 from anti-HIV_CDR
cacuacugggacagccgcucccccaucagcugggug

SEQ ID NO: 13723 - RNA, 36 nt, Artificial Sequence
  derived and/or modified sequence opt1 from anti-HIV_CDR
cacaagugggacagccgcagcccccuguccugggug

SEQ ID NO: 13724 - RNA, 36 nt, Artificial Sequence
  derived and/or modified sequence opt1 from anti-HIV_CDR
cacaugugggacagccgcuccggcuucagcuggucc

SEQ ID NO: 13725 - RNA, 36 nt, Artificial Sequence
  derived and/or modified sequence opt1 from anti-HIV_CDR
cacaucugggacagccgcgugcccaccaaguggguc

SEQ ID NO: 13726 - RNA, 36 nt, Artificial Sequence
  derived and/or modified sequence opt1 from anti-HIV_CDR
caggugugggacagcuccagcgaccaccccuggguc

SEQ ID NO: 13727 - RNA, 36 nt, Artificial Sequence
  derived and/or modified sequence opt1 from anti-HIV_CDR
cacaucuacgacgcccgccggcccaccaacugggug

SEQ ID NO: 13728 - RNA, 36 nt, Artificial Sequence
  derived and/or modified sequence opt1 from anti-HIV_CDR
cuggacggcgaggccuuccgcuacuaccucgaccug

SEQ ID NO: 13729 - RNA, 36 nt, Artificial Sequence
  derived and/or modified sequence opt1 from anti-HIV_CDR
ccccaguacaaccugggccgcgacccgcucgacgug

SEQ ID NO: 13730 - RNA, 36 nt, Artificial Sequence
  derived and/or modified sequence opt1 from anti-HIV_CDR
cccgagcccagcuccaucguggccccgcuguacuac

SEQ ID NO: 13731 - RNA, 36 nt, Artificial Sequence
  derived and/or modified sequence opt1 from anti-HIV_CDR
ggcgggggcgacgggcgcaacuggcaccugcacccc

SEQ ID NO: 13732 - RNA, 36 nt, Artificial Sequence
  derived and/or modified sequence opt1 from anti-HIV_CDR
cccaagagcggccgcgacuacugguccuucgaccug

SEQ ID NO: 13733 - RNA, 36 nt, Artificial Sequence
  derived and/or modified sequence opt1 from anti-HIV_CDR
ccccgcggcgggcgggacaacuggagcuuccacgug

SEQ ID NO: 13734 - RNA, 36 nt, Artificial Sequence
  derived and/or modified sequence opt1 from anti-HIV_CDR
ccccacagcccggacgacgccuggucccuggacgug

SEQ ID NO: 13735 - RNA, 36 nt, Artificial Sequence
  derived and/or modified sequence opt1 from anti-HIV_CDR
ccccugcgcggcggggacaccuggcacuaccacagc

SEQ ID NO: 13736 - RNA, 36 nt, Artificial Sequence
  derived and/or modified sequence opt1 from anti-HIV_CDR
cugcagcccguguacauccuccgcagcaucugccac

SEQ ID NO: 13737 - RNA, 36 nt, Artificial Sequence
  derived and/or modified sequence opt1 from anti-HIV_CDR
cugcagcccguguacauccucaagugcaacuggugc

SEQ ID NO: 13738 - RNA, 36 nt, Artificial Sequence
  derived and/or modified sequence opt1 from anti-HIV_CDR
gaguaccgcuucgacgacuggggcccccuggaccac

SEQ ID NO: 13739 - RNA, 36 nt, Artificial Sequence
  derived and/or modified sequence opt1 from anti-HIV_CDR
gccgccugggacgacagccugaacggccacggggug

SEQ ID NO: 13740 - RNA, 36 nt, Artificial Sequence
  derived and/or modified sequence opt1 from anti-HIV_CDR
cuguacuucgacugggccccccacgccuucgacauc

SEQ ID NO: 13741 - RNA, 36 nt, Artificial Sequence
  derived and/or modified sequence opt1 from anti-HIV_CDR
ggccuguacgacagcuccggguacuacuucggcuac

SEQ ID NO: 13742 - RNA, 36 nt, Artificial Sequence
  derived and/or modified sequence opt1 from anti-HIV_CDR
cugggcugcagcgggggcuccugcuacgaggacagc

SEQ ID NO: 13743 - RNA, 36 nt, Artificial Sequence
  derived and/or modified sequence opt1 from anti-HIV_CDR
gccagcggcuccuacauccuggggaccauggacgug

SEQ ID NO: 13744 - RNA, 36 nt, Artificial Sequence
  derived and/or modified sequence opt1 from anti-HIV_CDR
uacagcaccgacaacuccggcaagcagcacugggug

SEQ ID NO: 13745 - RNA, 36 nt, Artificial Sequence
  derived and/or modified sequence opt1 from anti-HIV_CDR
gugaagcaguuccuggaguggcucuaccuggacuac

SEQ ID NO: 13746 - RNA, 36 nt, Artificial Sequence
  derived and/or modified sequence opt1 from anti-HIV_CDR
ggcgugcgcagcaucgucggggcccacuucgacuac

SEQ ID NO: 13747 - RNA, 36 nt, Artificial Sequence
  derived and/or modified sequence opt1 from anti-HIV_CDR
ggcguggggacccgcuacuacgucuacuucgacagc

SEQ ID NO: 13748 - RNA, 36 nt, Artificial Sequence
  derived and/or modified sequence opt1 from anti-HIV_CDR
gcccccuacaucagcuccagccaccuggacuacugg

SEQ ID NO: 13749 - RNA, 36 nt, Artificial Sequence
  derived and/or modified sequence opt1 from anti-HIV_CDR
cgcggcaucgccgccgcgggguucuacuuccagcac

SEQ ID NO: 13750 - RNA, 36 nt, Artificial Sequence
  derived and/or modified sequence opt1 from anti-HIV_CDR
cgcggcaucgccgccgcggccuucuacuuccagacc

SEQ ID NO: 13751 - RNA, 36 nt, Artificial Sequence
  derived and/or modified sequence opt1 from anti-HIV_CDR
cgcggcaucgccgccgcgggguucuacuuccagaac

SEQ ID NO: 13752 - RNA, 36 nt, Artificial Sequence
  derived and/or modified sequence opt1 from anti-HIV_CDR
cagagcuacgacaccucccugaccgacacgggcgug

SEQ ID NO: 13753 - RNA, 36 nt, Artificial Sequence
  derived and/or modified sequence opt1 from anti-HIV_CDR
cagagcuacgacaccucccugagcgacaccggcgug

SEQ ID NO: 13754 - RNA, 36 nt, Artificial Sequence
  derived and/or modified sequence opt1 from anti-HIV_CDR
cgcaccacccuggugaacuucggcgucuucgaccuc

SEQ ID NO: 13755 - RNA, 36 nt, Artificial Sequence
  derived and/or modified sequence opt1 from anti-HIV_CDR
cccguggucaacaccauccugccguacugcgacgug

SEQ ID NO: 13756 - RNA, 36 nt, Artificial Sequence
  derived and/or modified sequence opt1 from anti-HIV_CDR
ugcuacagcggccgcucccgguacuucuucgacagc

SEQ ID NO: 13757 - RNA, 36 nt, Artificial Sequence
  derived and/or modified sequence opt1 from anti-HIV_CDR
gccgccugggacgacagccuggacggcuucugggug

SEQ ID NO: 13758 - RNA, 36 nt, Artificial Sequence
  derived and/or modified sequence opt1 from anti-HIV_CDR
cugcgccggggcuacuacgacagcggggaggacuac

SEQ ID NO: 13759 - RNA, 36 nt, Artificial Sequence
  derived and/or modified sequence opt1 from anti-HIV_CDR
cugcgccggggcuacuucgacagcgggggcgaccac

SEQ ID NO: 13760 - RNA, 36 nt, Artificial Sequence
  derived and/or modified sequence opt1 from anti-HIV_CDR
agcuccuacaccagcuccagcacccugggcgugguc

SEQ ID NO: 13761 - RNA, 36 nt, Artificial Sequence
  derived and/or modified sequence opt1 from anti-HIV_CDR
cuggacggcgaggccuuccgcuacuacuucgacagc

SEQ ID NO: 13762 - RNA, 36 nt, Artificial Sequence
  derived and/or modified sequence opt1 from anti-HIV_CDR
cgccggggccagcgccugcucgccuacuucgacuac

SEQ ID NO: 13763 - RNA, 36 nt, Artificial Sequence
  derived and/or modified sequence opt1 from anti-HIV_CDR
ccccaguacaaccugggccgcgagccgcucaacgug

SEQ ID NO: 13764 - RNA, 36 nt, Artificial Sequence
  derived and/or modified sequence opt1 from anti-HIV_CDR
gcccaccacgacuucuggcgcgcccccguggacguc

SEQ ID NO: 13765 - RNA, 36 nt, Artificial Sequence
  derived and/or modified sequence opt1 from anti-HIV_CDR
ggccgccgggaggggcugaacuuccuccuggacuac

SEQ ID NO: 13766 - RNA, 36 nt, Artificial Sequence
  derived and/or modified sequence opt1 from anti-HIV_CDR
cccgagccgagcuccaucgugggcgcccuguacuac

SEQ ID NO: 13767 - RNA, 36 nt, Artificial Sequence
  derived and/or modified sequence opt1 from anti-HIV_CDR
ggccccgacgacuucuggagcggguacccgaaguac

SEQ ID NO: 13768 - RNA, 36 nt, Artificial Sequence
  derived and/or modified sequence opt1 from anti-HIV_CDR
gacuacagcgccgccggccgccaccuguucgacucc

SEQ ID NO: 13769 - RNA, 36 nt, Artificial Sequence
  derived and/or modified sequence opt1 from anti-HIV_CDR
gacuacaccgcccgcggccggcacuucuucgacuac

SEQ ID NO: 13770 - RNA, 36 nt, Artificial Sequence
  derived and/or modified sequence opt1 from anti-HIV_CDR
gacuacaccgccagcggccgccacuucuucgacuac

SEQ ID NO: 13771 - RNA, 36 nt, Artificial Sequence
  derived and/or modified sequence opt1 from anti-HIV_CDR
cagagcuacgacuccagccuguccggcagcugggug

SEQ ID NO: 13772 - RNA, 36 nt, Artificial Sequence
  derived and/or modified sequence opt1 from anti-HIV_CDR
cccgcccaggccggcguggggccgcgcuucgacuac

SEQ ID NO: 13773 - RNA, 36 nt, Artificial Sequence
  derived and/or modified sequence opt1 from anti-HIV_CDR
ggcgccaucaacagcagcccccuguacuucgacucc

SEQ ID NO: 13774 - RNA, 36 nt, Artificial Sequence
  derived and/or modified sequence opt1 from anti-HIV_CDR
ggcgacaucaccuccagcccccuguacuucgacuuc

SEQ ID NO: 13775 - RNA, 36 nt, Artificial Sequence
  derived and/or modified sequence opt1 from anti-HIV_CDR
ggcgccaucaacagcucccccagcuacuucgacucc

SEQ ID NO: 13776 - RNA, 36 nt, Artificial Sequence
  derived and/or modified sequence opt1 from anti-HIV_CDR
uggguggucaccgccgccgaggaguacuucgacuac

SEQ ID NO: 13777 - RNA, 39 nt, Artificial Sequence
  derived and/or modified sequence opt1 from anti-HIV_CDR
gacccccagguggagguccgcggcaacgccuucgacauc

SEQ ID NO: 13778 - RNA, 39 nt, Artificial Sequence
  derived and/or modified sequence opt1 from anti-HIV_CDR
gaccacggcgacccccgcaccggguacuacuucgacuac

SEQ ID NO: 13779 - RNA, 39 nt, Artificial Sequence
  derived and/or modified sequence opt1 from anti-HIV_CDR
gacgagagcggcuacgaccugaacuggcaccucgacucc

SEQ ID NO: 13780 - RNA, 39 nt, Artificial Sequence
  derived and/or modified sequence opt1 from anti-HIV_CDR
gacggcagcggggacgaccgcaacuggcaccuggacccc

SEQ ID NO: 13781 - RNA, 39 nt, Artificial Sequence
  derived and/or modified sequence opt1 from anti-HIV_CDR
gaccgccgggacgacggccuggacuggcuccuggacccc

SEQ ID NO: 13782 - RNA, 39 nt, Artificial Sequence
  derived and/or modified sequence opt1 from anti-HIV_CDR
gacggcgggggcgacgaccgcaccuggcugcucgacgcc

SEQ ID NO: 13783 - RNA, 39 nt, Artificial Sequence
  derived and/or modified sequence opt1 from anti-HIV_CDR
gacggcagcggggacgcccgcgacuggcaccugcacccc

SEQ ID NO: 13784 - RNA, 39 nt, Artificial Sequence
  derived and/or modified sequence opt1 from anti-HIV_CDR
gacggcagcggggacgacaccuccugguaccuggacccc

SEQ ID NO: 13785 - RNA, 39 nt, Artificial Sequence
  derived and/or modified sequence opt1 from anti-HIV_CDR
gacggcagcggggacgacaccuccuggcaccuggacccc

SEQ ID NO: 13786 - RNA, 39 nt, Artificial Sequence
  derived and/or modified sequence opt1 from anti-HIV_CDR
gaccgccgggacgacgaccgcgccuggcugcucgacccc

SEQ ID NO: 13787 - RNA, 39 nt, Artificial Sequence
  derived and/or modified sequence opt1 from anti-HIV_CDR
gacggcagcggggacgcccgcgacuggcaccuggacccc

SEQ ID NO: 13788 - RNA, 39 nt, Artificial Sequence
  derived and/or modified sequence opt1 from anti-HIV_CDR
gacggcagcggggacgccaccuccuggcaccugcacccc

SEQ ID NO: 13789 - RNA, 39 nt, Artificial Sequence
  derived and/or modified sequence opt1 from anti-HIV_CDR
gacgagagcggcgacgaccugaaguggcaccuccacccc

SEQ ID NO: 13790 - RNA, 39 nt, Artificial Sequence
  derived and/or modified sequence opt1 from anti-HIV_CDR
gacggcagcggggacgacaccuccuggcaccugcacccc

SEQ ID NO: 13791 - RNA, 39 nt, Artificial Sequence
  derived and/or modified sequence opt1 from anti-HIV_CDR
gcccagggcgacauccugaccgagggguacuucgacuac

SEQ ID NO: 13792 - RNA, 39 nt, Artificial Sequence
  derived and/or modified sequence opt1 from anti-HIV_CDR
gaccgcauguucuggcagcagcuggccaaguacgacagc

SEQ ID NO: 13793 - RNA, 39 nt, Artificial Sequence
  derived and/or modified sequence opt1 from anti-HIV_CDR
agcaccugggacuacucccugagcgcccacgaggacgug

SEQ ID NO: 13794 - RNA, 39 nt, Artificial Sequence
  derived and/or modified sequence opt1 from anti-HIV_CDR
gccgccugggacgacagccuguccggccucaacugggug

SEQ ID NO: 13795 - RNA, 39 nt, Artificial Sequence
  derived and/or modified sequence opt1 from anti-HIV_CDR
cugagcuccgaccgcaucguggucgugggccccgacuac

SEQ ID NO: 13796 - RNA, 39 nt, Artificial Sequence
  derived and/or modified sequence opt1 from anti-HIV_CDR
gaggccggcagcgugaccgccaccgggcccuucgacucc

SEQ ID NO: 13797 - RNA, 39 nt, Artificial Sequence
  derived and/or modified sequence opt1 from anti-HIV_CDR
gacuucggccgcgccuacgccaucggguacuucgaguac

SEQ ID NO: 13798 - RNA, 39 nt, Artificial Sequence
  derived and/or modified sequence opt1 from anti-HIV_CDR
gaccgcgcccccuacggcgccuucgagccguucgacuuc

SEQ ID NO: 13799 - RNA, 39 nt, Artificial Sequence
  derived and/or modified sequence opt1 from anti-HIV_CDR
aacgggcacagcucccugggcggcggguacuucccccac

SEQ ID NO: 13800 - RNA, 39 nt, Artificial Sequence
  derived and/or modified sequence opt1 from anti-HIV_CDR
aacggccacagcgcccugggcggggaguacuuccagcac

SEQ ID NO: 13801 - RNA, 39 nt, Artificial Sequence
  derived and/or modified sequence opt1 from anti-HIV_CDR
gccgcccgccgggcguucuacuacuacuacauggacgug

SEQ ID NO: 13802 - RNA, 39 nt, Artificial Sequence
  derived and/or modified sequence opt1 from anti-HIV_CDR
gccaacuacuacgacagcuccggcuacgggcuggacauc

SEQ ID NO: 13803 - RNA, 39 nt, Artificial Sequence
  derived and/or modified sequence opt1 from anti-HIV_CDR
cacagccgccccggcgccccgccccacuacuucgacuac

SEQ ID NO: 13804 - RNA, 39 nt, Artificial Sequence
  derived and/or modified sequence opt1 from anti-HIV_CDR
ggccugaccguggccacccucuacgacgccuucgacguc

SEQ ID NO: 13805 - RNA, 39 nt, Artificial Sequence
  derived and/or modified sequence opt1 from anti-HIV_CDR
cgcgaccgguacaacuggaaguacuacuaccuggacgug

SEQ ID NO: 13806 - RNA, 39 nt, Artificial Sequence
  derived and/or modified sequence opt1 from anti-HIV_CDR
gaccgcggcagcuccgggugguacggcuggcuggacccc

SEQ ID NO: 13807 - RNA, 39 nt, Artificial Sequence
  derived and/or modified sequence opt1 from anti-HIV_CDR
gaccgccugagcuccuucuggagcggcgggaucgaccag

SEQ ID NO: 13808 - RNA, 39 nt, Artificial Sequence
  derived and/or modified sequence opt1 from anti-HIV_CDR
gacgugaucgucggcgcccugcucggggccuucgacauc

SEQ ID NO: 13809 - RNA, 39 nt, Artificial Sequence
  derived and/or modified sequence opt1 from anti-HIV_CDR
caccugaucgcccccaccgccggcaacuacuucuacccg

SEQ ID NO: 13810 - RNA, 39 nt, Artificial Sequence
  derived and/or modified sequence opt1 from anti-HIV_CDR
gacagccgcccccaggcccugguggccgcgcucgacguc

SEQ ID NO: 13811 - RNA, 39 nt, Artificial Sequence
  derived and/or modified sequence opt1 from anti-HIV_CDR
gacgagaucgugggcgcccugcucggggccuucgacauc

SEQ ID NO: 13812 - RNA, 39 nt, Artificial Sequence
  derived and/or modified sequence opt1 from anti-HIV_CDR
agcgaccccgccaucgccgcggccggcucccuggaccuc

SEQ ID NO: 13813 - RNA, 39 nt, Artificial Sequence
  derived and/or modified sequence opt1 from anti-HIV_CDR
cccuacgugcagaccgucgccaccacgaccuucgacuuc

SEQ ID NO: 13814 - RNA, 39 nt, Artificial Sequence
  derived and/or modified sequence opt1 from anti-HIV_CDR
ggccccaagagcguggccucccugagcuacuucgacaag

SEQ ID NO: 13815 - RNA, 39 nt, Artificial Sequence
  derived and/or modified sequence opt1 from anti-HIV_CDR
ggcgcccugugguucgggcagcuccgcggccuggacccc

SEQ ID NO: 13816 - RNA, 39 nt, Artificial Sequence
  derived and/or modified sequence opt1 from anti-HIV_CDR
gaccugcgccccaugcggggcaacugggccaugcacgug

SEQ ID NO: 13817 - RNA, 39 nt, Artificial Sequence
  derived and/or modified sequence opt1 from anti-HIV_CDR
gacccccaggugaaccgccggggcaacugcuucgaccac

SEQ ID NO: 13818 - RNA, 39 nt, Artificial Sequence
  derived and/or modified sequence opt1 from anti-HIV_CDR
gacccccagaucgagauccgcggcaacgccuucgacauc

SEQ ID NO: 13819 - RNA, 39 nt, Artificial Sequence
  derived and/or modified sequence opt1 from anti-HIV_CDR
gugccccgcaccaccgccacgcggaacgccuucgacauc

SEQ ID NO: 13820 - RNA, 39 nt, Artificial Sequence
  derived and/or modified sequence opt1 from anti-HIV_CDR
cacaagagcgugcugcucugguuccgcgagcuggacuac

SEQ ID NO: 13821 - RNA, 39 nt, Artificial Sequence
  derived and/or modified sequence opt1 from anti-HIV_CDR
gacagcgaggacuacguggacuacuacuacauggacguc

SEQ ID NO: 13822 - RNA, 39 nt, Artificial Sequence
  derived and/or modified sequence opt1 from anti-HIV_CDR
cugccccgcaccaccggcauccggaacgccuucgacauc

SEQ ID NO: 13823 - RNA, 39 nt, Artificial Sequence
  derived and/or modified sequence opt1 from anti-HIV_CDR
cugccccgcaccaccggcauccggaacgccuucgacuuc

SEQ ID NO: 13824 - RNA, 42 nt, Artificial Sequence
  derived and/or modified sequence opt1 from anti-HIV_CDR
ggcacccugugguucggggagagcggccuccgccuggaccac

SEQ ID NO: 13825 - RNA, 42 nt, Artificial Sequence
  derived and/or modified sequence opt1 from anti-HIV_CDR
guggccuacguccacguggugaccacccgcagccuggacaac

SEQ ID NO: 13826 - RNA, 42 nt, Artificial Sequence
  derived and/or modified sequence opt1 from anti-HIV_CDR
gccgacuacgaccugcucaccagcuccuaccacuucgacagc

SEQ ID NO: 13827 - RNA, 42 nt, Artificial Sequence
  derived and/or modified sequence opt1 from anti-HIV_CDR
acccgcugcuucggcgccaacugcuucaacuucauggacgug

SEQ ID NO: 13828 - RNA, 42 nt, Artificial Sequence
  derived and/or modified sequence opt1 from anti-HIV_CDR
ggcgggcuguacugcagcuccaucagcugcaucauggacgug

SEQ ID NO: 13829 - RNA, 42 nt, Artificial Sequence
  derived and/or modified sequence opt1 from anti-HIV_CDR
aacgagccccaguaccacagccugccgggcauguucgacuac

SEQ ID NO: 13830 - RNA, 42 nt, Artificial Sequence
  derived and/or modified sequence opt1 from anti-HIV_CDR
gagccccgcgagaugggcacccugaccgccggguucgaguac

SEQ ID NO: 13831 - RNA, 42 nt, Artificial Sequence
  derived and/or modified sequence opt1 from anti-HIV_CDR
gccaccggcuacagcuacggguaccuggacgccuucgacauc

SEQ ID NO: 13832 - RNA, 42 nt, Artificial Sequence
  derived and/or modified sequence opt1 from anti-HIV_CDR
ggcagccugugguucggggaguccggccuccgccuggaccac

SEQ ID NO: 13833 - RNA, 42 nt, Artificial Sequence
  derived and/or modified sequence opt1 from anti-HIV_CDR
gacaacaccaucagcggcguggucccccgcugguucgacuac

SEQ ID NO: 13834 - RNA, 42 nt, Artificial Sequence
  derived and/or modified sequence opt1 from anti-HIV_CDR
aucuacgacggccgcggguacuacagcuacuucuucgaccug

SEQ ID NO: 13835 - RNA, 42 nt, Artificial Sequence
  derived and/or modified sequence opt1 from anti-HIV_CDR
gaccgcuucaacuggaacgacggcggguacuucuucgacagc

SEQ ID NO: 13836 - RNA, 42 nt, Artificial Sequence
  derived and/or modified sequence opt1 from anti-HIV_CDR
ggccacagcuccagcuggaccaaguucaacugguucgggccc

SEQ ID NO: 13837 - RNA, 42 nt, Artificial Sequence
  derived and/or modified sequence opt1 from anti-HIV_CDR
agcaucgccgccgacgacuacuacuacuacuacauggacgug

SEQ ID NO: 13838 - RNA, 42 nt, Artificial Sequence
  derived and/or modified sequence opt1 from anti-HIV_CDR
agcuucuacgacaacggcggguacuaccugggccucgacuac

SEQ ID NO: 13839 - RNA, 42 nt, Artificial Sequence
  derived and/or modified sequence opt1 from anti-HIV_CDR
gacaaggacgccagcaucuacggcuaccgcauccugaaccac

SEQ ID NO: 13840 - RNA, 42 nt, Artificial Sequence
  derived and/or modified sequence opt1 from anti-HIV_CDR
gugcugaccgaccucgaccagggcaacccccgcauggacguc

SEQ ID NO: 13841 - RNA, 42 nt, Artificial Sequence
  derived and/or modified sequence opt1 from anti-HIV_CDR
cgcgagaucaaguucggcgagcugagcuucuacuucgacucc

SEQ ID NO: 13842 - RNA, 42 nt, Artificial Sequence
  derived and/or modified sequence opt1 from anti-HIV_CDR
cgcgagauccgguucggcgagcugagcuucuacuucgacuac

SEQ ID NO: 13843 - RNA, 42 nt, Artificial Sequence
  derived and/or modified sequence opt1 from anti-HIV_CDR
ccccacagcccgaccaacauccccucccgcccccuggacuac

SEQ ID NO: 13844 - RNA, 42 nt, Artificial Sequence
  derived and/or modified sequence opt1 from anti-HIV_CDR
ggcgacuacgacauccugaccagcuccuaccaguucgacuac

SEQ ID NO: 13845 - RNA, 42 nt, Artificial Sequence
  derived and/or modified sequence opt1 from anti-HIV_CDR
agcaccccccugguguggccgcccgccaacggccucgacguc

SEQ ID NO: 13846 - RNA, 42 nt, Artificial Sequence
  derived and/or modified sequence opt1 from anti-HIV_CDR
acccgcaacaccggcaacagccugcccuacugguucgaccuc

SEQ ID NO: 13847 - RNA, 45 nt, Artificial Sequence
  derived and/or modified sequence opt1 from anti-HIV_CDR
gagaagggccaguggcugaccgugcccccguacuacuucgacagc

SEQ ID NO: 13848 - RNA, 45 nt, Artificial Sequence
  derived and/or modified sequence opt1 from anti-HIV_CDR
ggcagcgggcgcuggaccaucggcgcccggaucuacuucgacaac

SEQ ID NO: 13849 - RNA, 45 nt, Artificial Sequence
  derived and/or modified sequence opt1 from anti-HIV_CDR
cuggaggccgacggcgccgacuacagccccaagauguucgacuuc

SEQ ID NO: 13850 - RNA, 45 nt, Artificial Sequence
  derived and/or modified sequence opt1 from anti-HIV_CDR
cuggaggccgacggcggggacuacagccccaagauguucgacuac

SEQ ID NO: 13851 - RNA, 45 nt, Artificial Sequence
  derived and/or modified sequence opt1 from anti-HIV_CDR
cuggaggccgacggcgacaacuacagccccaagaugguggacuac

SEQ ID NO: 13852 - RNA, 45 nt, Artificial Sequence
  derived and/or modified sequence opt1 from anti-HIV_CDR
cuggaggccgacggcgacgacuacagccccaagauguucgacuac

SEQ ID NO: 13853 - RNA, 45 nt, Artificial Sequence
  derived and/or modified sequence opt1 from anti-HIV_CDR
cuggaggccgacggcagcgacuacucccccaagauguucgacuuc

SEQ ID NO: 13854 - RNA, 45 nt, Artificial Sequence
  derived and/or modified sequence opt1 from anti-HIV_CDR
cuggaggccgacggcgacgacuacagccccaagauguucgaccac

SEQ ID NO: 13855 - RNA, 45 nt, Artificial Sequence
  derived and/or modified sequence opt1 from anti-HIV_CDR
cuggaggccgacggcgacgacuacagccccaagaugguggacuac

SEQ ID NO: 13856 - RNA, 45 nt, Artificial Sequence
  derived and/or modified sequence opt1 from anti-HIV_CDR
gccccccgccuggaccucggcgagcugagcuccggguuccacuuc

SEQ ID NO: 13857 - RNA, 45 nt, Artificial Sequence
  derived and/or modified sequence opt1 from anti-HIV_CDR
gccccccgccuggagcucggcgagcugagcuccggguuccacuac

SEQ ID NO: 13858 - RNA, 45 nt, Artificial Sequence
  derived and/or modified sequence opt1 from anti-HIV_CDR
ggccggcugcucaugcaguggcccccgcgcgggggcuucgacccc

SEQ ID NO: 13859 - RNA, 45 nt, Artificial Sequence
  derived and/or modified sequence opt1 from anti-HIV_CDR
ggccggcuguucaugcaguggcccccgcgcgggggcuucgacccc

SEQ ID NO: 13860 - RNA, 45 nt, Artificial Sequence
  derived and/or modified sequence opt1 from anti-HIV_CDR
ggccgccuguucgugcaguggcccccgcagggcggguucgacccc

SEQ ID NO: 13861 - RNA, 45 nt, Artificial Sequence
  derived and/or modified sequence opt1 from anti-HIV_CDR
ggccgccuguucaugcaguggcccccgcagggcggguucgacccc

SEQ ID NO: 13862 - RNA, 45 nt, Artificial Sequence
  derived and/or modified sequence opt1 from anti-HIV_CDR
ggccgccuguucgugcaguggcccccgcagggcggguucgacacc

SEQ ID NO: 13863 - RNA, 45 nt, Artificial Sequence
  derived and/or modified sequence opt1 from anti-HIV_CDR
aacaacaacacccgcaagagcaucaacaucggccccgggcgggcc

SEQ ID NO: 13864 - RNA, 45 nt, Artificial Sequence
  derived and/or modified sequence opt1 from anti-HIV_CDR
cccggcuacugcaacaacaacaucugcacccacugguucgacacc

SEQ ID NO: 13865 - RNA, 45 nt, Artificial Sequence
  derived and/or modified sequence opt1 from anti-HIV_CDR
gaccugcuccccgacuacccggugagcuccgcccccgaggacuuc

SEQ ID NO: 13866 - RNA, 45 nt, Artificial Sequence
  derived and/or modified sequence opt1 from anti-HIV_CDR
gagagcuggcuguacuccaacggcgacuacuacuacauggacgug

SEQ ID NO: 13867 - RNA, 45 nt, Artificial Sequence
  derived and/or modified sequence opt1 from anti-HIV_CDR
cgcuacugcagcuccaccaccugcuaccggggccacuucgacuac

SEQ ID NO: 13868 - RNA, 45 nt, Artificial Sequence
  derived and/or modified sequence opt1 from anti-HIV_CDR
cagaccaccgacgagggccgccaguggcuggugggguuccagcac

SEQ ID NO: 13869 - RNA, 45 nt, Artificial Sequence
  derived and/or modified sequence opt1 from anti-HIV_CDR
cccagcuacggcggguacgacgaccagggcugguacuucgaguac

SEQ ID NO: 13870 - RNA, 45 nt, Artificial Sequence
  derived and/or modified sequence opt1 from anti-HIV_CDR
gccgccauccccaucggcgacagcaaguacuccuacuucgacagc

SEQ ID NO: 13871 - RNA, 45 nt, Artificial Sequence
  derived and/or modified sequence opt1 from anti-HIV_CDR
gcccccccgcccggcagcaccgagugggccuacuacuucgacuac

SEQ ID NO: 13872 - RNA, 45 nt, Artificial Sequence
  derived and/or modified sequence opt1 from anti-HIV_CDR
gcccaguuccacaacagcggcuacuacuacuccgggcuggacuac

SEQ ID NO: 13873 - RNA, 45 nt, Artificial Sequence
  derived and/or modified sequence opt1 from anti-HIV_CDR
ggcggguacgacuacggcgaccacuacuacuacuacauggacgug

SEQ ID NO: 13874 - RNA, 45 nt, Artificial Sequence
  derived and/or modified sequence opt1 from anti-HIV_CDR
ggcacccagagcuacuccgccguggcccccgggugguucgacccg

SEQ ID NO: 13875 - RNA, 45 nt, Artificial Sequence
  derived and/or modified sequence opt1 from anti-HIV_CDR
aucaaggggcccccgcgcggcaacuucggcguggccuucuacuuc

SEQ ID NO: 13876 - RNA, 45 nt, Artificial Sequence
  derived and/or modified sequence opt1 from anti-HIV_CDR
aagguguacagcgacggcugguccccgcccaccggguucgucuac

SEQ ID NO: 13877 - RNA, 45 nt, Artificial Sequence
  derived and/or modified sequence opt1 from anti-HIV_CDR
cgcuacaaguaccugcccggcgaccagcacaugccgugggacaac

SEQ ID NO: 13878 - RNA, 45 nt, Artificial Sequence
  derived and/or modified sequence opt1 from anti-HIV_CDR
cgcuacaaguaccugcccggcgaccagcacaugccgugggacuac

SEQ ID NO: 13879 - RNA, 45 nt, Artificial Sequence
  derived and/or modified sequence opt1 from anti-HIV_CDR
ggcgggggcuacgccguggucgggcccaaguacggccuggacgug

SEQ ID NO: 13880 - RNA, 45 nt, Artificial Sequence
  derived and/or modified sequence opt1 from anti-HIV_CDR
cuggacagcuccagcggcugggaggaggugggguacuucgaccgc

SEQ ID NO: 13881 - RNA, 45 nt, Artificial Sequence
  derived and/or modified sequence opt1 from anti-HIV_CDR
gagaacuacagcgacggcugggaggagguggggcacuucgacuac

SEQ ID NO: 13882 - RNA, 45 nt, Artificial Sequence
  derived and/or modified sequence opt1 from anti-HIV_CDR
gagaacuacagcgacggcugggaggagguggggcacuucgacucc

SEQ ID NO: 13883 - RNA, 45 nt, Artificial Sequence
  derived and/or modified sequence opt1 from anti-HIV_CDR
gagaacuacagcgacggcuggaacgagguggggcacuucgacuuc

SEQ ID NO: 13884 - RNA, 45 nt, Artificial Sequence
  derived and/or modified sequence opt1 from anti-HIV_CDR
gagaacuacagcgacggcugguacgagguggggcacuucgaccug

SEQ ID NO: 13885 - RNA, 45 nt, Artificial Sequence
  derived and/or modified sequence opt1 from anti-HIV_CDR
gaccgccggcgcuuccuggaguggagccucuacggcauggacgug

SEQ ID NO: 13886 - RNA, 45 nt, Artificial Sequence
  derived and/or modified sequence opt1 from anti-HIV_CDR
ggcccccgcguguucuucgagagcuccggguacuacuuccgggac

SEQ ID NO: 13887 - RNA, 45 nt, Artificial Sequence
  derived and/or modified sequence opt1 from anti-HIV_CDR
ggcccccgcgugcuguucgagagcuccgggcacuaccuccgggac

SEQ ID NO: 13888 - RNA, 45 nt, Artificial Sequence
  derived and/or modified sequence opt1 from anti-HIV_CDR
ggcccccgcguguucuucgagagcuccggguacuacuuccggaac

SEQ ID NO: 13889 - RNA, 45 nt, Artificial Sequence
  derived and/or modified sequence opt1 from anti-HIV_CDR
gagggcgggagccugugguucggcggggccaacuggcucgacccc

SEQ ID NO: 13890 - RNA, 45 nt, Artificial Sequence
  derived and/or modified sequence opt1 from anti-HIV_CDR
gccgacuacgacaacaucugggacagccgcggcggguucgaccug

SEQ ID NO: 13891 - RNA, 45 nt, Artificial Sequence
  derived and/or modified sequence opt1 from anti-HIV_CDR
gugggcgggaccgucuggagcggcuacuccaacuaccuggacuac

SEQ ID NO: 13892 - RNA, 45 nt, Artificial Sequence
  derived and/or modified sequence opt1 from anti-HIV_CDR
gacaaccgcgaccaguggcuggugcuccggagcugguucgacccc

SEQ ID NO: 13893 - RNA, 45 nt, Artificial Sequence
  derived and/or modified sequence opt1 from anti-HIV_CDR
gagaagggccagugggugacccugcccccguacuacuucgacagc

SEQ ID NO: 13894 - RNA, 48 nt, Artificial Sequence
  derived and/or modified sequence opt1 from anti-HIV_CDR
uacuucagcgacaccgaccgcuccgaguacagccccucccugcggagc

SEQ ID NO: 13895 - RNA, 48 nt, Artificial Sequence
  derived and/or modified sequence opt1 from anti-HIV_CDR
uacaucagcgaccgcgaguccgccaccuacaaccccagccugaacucc

SEQ ID NO: 13896 - RNA, 48 nt, Artificial Sequence
  derived and/or modified sequence opt1 from anti-HIV_CDR
uacuucagcgacaccgagaaguccaacuacaaccccagccugcgcucc

SEQ ID NO: 13897 - RNA, 48 nt, Artificial Sequence
  derived and/or modified sequence opt1 from anti-HIV_CDR
uacaucagcgaccgcgccuccgccaccuacaaccccagccugaacucc

SEQ ID NO: 13898 - RNA, 48 nt, Artificial Sequence
  derived and/or modified sequence opt1 from anti-HIV_CDR
uacgugcaccacagcggcgacaccaacuacaaccccucccugaagcgc

SEQ ID NO: 13899 - RNA, 48 nt, Artificial Sequence
  derived and/or modified sequence opt1 from anti-HIV_CDR
uacgugcacaagagcggcgacaccaacuacucccccagccugaagucc

SEQ ID NO: 13900 - RNA, 48 nt, Artificial Sequence
  derived and/or modified sequence opt1 from anti-HIV_CDR
uacgugcacgacagcggcgacaccaacuacaaccccagccugaagucc

SEQ ID NO: 13901 - RNA, 48 nt, Artificial Sequence
  derived and/or modified sequence opt1 from anti-HIV_CDR
uacaucagcaaguccgagagcgccaacuacaaccccucccugaacagc

SEQ ID NO: 13902 - RNA, 48 nt, Artificial Sequence
  derived and/or modified sequence opt1 from anti-HIV_CDR
uacaucuacuacagcggcuccaccaacuacaaccccagccugaagucc

SEQ ID NO: 13903 - RNA, 48 nt, Artificial Sequence
  derived and/or modified sequence opt1 from anti-HIV_CDR
uacgugcacgacagcggcgacaucaacuacaaccccucccugaagaac

SEQ ID NO: 13904 - RNA, 48 nt, Artificial Sequence
  derived and/or modified sequence opt1 from anti-HIV_CDR
agcuacuacgacuucuccaucggcgacgggaacgacgccuucgacgug

SEQ ID NO: 13905 - RNA, 48 nt, Artificial Sequence
  derived and/or modified sequence opt1 from anti-HIV_CDR
ggcuuccgcgggagccccuucuccagcggcucccuguacuucgacagc

SEQ ID NO: 13906 - RNA, 48 nt, Artificial Sequence
  derived and/or modified sequence opt1 from anti-HIV_CDR
gugaucagcggccgcaucaccaucuucuacuacaacuacaucgacguc

SEQ ID NO: 13907 - RNA, 48 nt, Artificial Sequence
  derived and/or modified sequence opt1 from anti-HIV_CDR
gacggccugggggagguggcccccgacuaccgcuacggcaucgacguc

SEQ ID NO: 13908 - RNA, 48 nt, Artificial Sequence
  derived and/or modified sequence opt1 from anti-HIV_CDR
gacggccugggggagcucgcccccgccuaccaguacggcaucgacgug

SEQ ID NO: 13909 - RNA, 48 nt, Artificial Sequence
  derived and/or modified sequence opt1 from anti-HIV_CDR
gacggccugggggagcucgcccccgccuaccacuacggcaucgacgug

SEQ ID NO: 13910 - RNA, 48 nt, Artificial Sequence
  derived and/or modified sequence opt1 from anti-HIV_CDR
gacggccugggggagguggcccccgccuaccucuacggcaucgacgcg

SEQ ID NO: 13911 - RNA, 48 nt, Artificial Sequence
  derived and/or modified sequence opt1 from anti-HIV_CDR
gccgugaagggcuucugguucgacgaggucuacaacugguucgggccc

SEQ ID NO: 13912 - RNA, 48 nt, Artificial Sequence
  derived and/or modified sequence opt1 from anti-HIV_CDR
gccgugaagggcuucugguucgacgaccccuacaccugguucgggccg

SEQ ID NO: 13913 - RNA, 48 nt, Artificial Sequence
  derived and/or modified sequence opt1 from anti-HIV_CDR
gccgugaagggcuucugguucgacgagcccagcaccugguucgggccg

SEQ ID NO: 13914 - RNA, 48 nt, Artificial Sequence
  derived and/or modified sequence opt1 from anti-HIV_CDR
gccgugaagggccugugguucgacgagaccuacaccugguucgggccc

SEQ ID NO: 13915 - RNA, 48 nt, Artificial Sequence
  derived and/or modified sequence opt1 from anti-HIV_CDR
gccguggccggccugugguucgaggacgcguacaacugguucgggccc

SEQ ID NO: 13916 - RNA, 48 nt, Artificial Sequence
  derived and/or modified sequence opt1 from anti-HIV_CDR
gccgaggccgagagccagucccacagccgccccaucauguucgacuac

SEQ ID NO: 13917 - RNA, 48 nt, Artificial Sequence
  derived and/or modified sequence opt1 from anti-HIV_CDR
gccgaggccgcgagcgacucccacagccgccccaucauguucgaccac

SEQ ID NO: 13918 - RNA, 48 nt, Artificial Sequence
  derived and/or modified sequence opt1 from anti-HIV_CDR
cuggaggccgagagcgacucccacagccgccccaucauguucgaccac

SEQ ID NO: 13919 - RNA, 48 nt, Artificial Sequence
  derived and/or modified sequence opt1 from anti-HIV_CDR
gccgaggccgagagccagucccacagccgccccaucauguucgacucc

SEQ ID NO: 13920 - RNA, 48 nt, Artificial Sequence
  derived and/or modified sequence opt1 from anti-HIV_CDR
gccgaggccgagagccagucccacagccgccccaucauguucgacuuc

SEQ ID NO: 13921 - RNA, 48 nt, Artificial Sequence
  derived and/or modified sequence opt1 from anti-HIV_CDR
gacaacccccugcuccagagcggcgaguucuccagcucccuggagaac

SEQ ID NO: 13922 - RNA, 48 nt, Artificial Sequence
  derived and/or modified sequence opt1 from anti-HIV_CDR
gacaacccccugcuccagagcggcgaguucuccagcucccuggacaac

SEQ ID NO: 13923 - RNA, 48 nt, Artificial Sequence
  derived and/or modified sequence opt1 from anti-HIV_CDR
ggccgcgacuacaacuucuggggcgggggcgggaagaucaacuucccc

SEQ ID NO: 13924 - RNA, 48 nt, Artificial Sequence
  derived and/or modified sequence opt1 from anti-HIV_CDR
accaacugggccaacgacuucgugaccggcuacuaccgcuucgacuuc

SEQ ID NO: 13925 - RNA, 48 nt, Artificial Sequence
  derived and/or modified sequence opt1 from anti-HIV_CDR
gccggccacugcagcuccaccagcuccguguacugccccuucgacaug

SEQ ID NO: 13926 - RNA, 48 nt, Artificial Sequence
  derived and/or modified sequence opt1 from anti-HIV_CDR
caggugagcuccuacagcuccagcggcuaccgccgggaguucgacuac

SEQ ID NO: 13927 - RNA, 48 nt, Artificial Sequence
  derived and/or modified sequence opt1 from anti-HIV_CDR
cgcauggccacccugaccggcggguacuacuacuacuacauggacgug

SEQ ID NO: 13928 - RNA, 48 nt, Artificial Sequence
  derived and/or modified sequence opt1 from anti-HIV_CDR
gagggcggguacagcgacuucugguccggcuacagcggguucgacuac

SEQ ID NO: 13929 - RNA, 48 nt, Artificial Sequence
  derived and/or modified sequence opt1 from anti-HIV_CDR
cuguacuacaacuucggcagcggguacgacaccggcaucggggaccac

SEQ ID NO: 13930 - RNA, 48 nt, Artificial Sequence
  derived and/or modified sequence opt1 from anti-HIV_CDR
gcccgcgagggccggugguucagcgacaacuacuacgccauggacgug

SEQ ID NO: 13931 - RNA, 48 nt, Artificial Sequence
  derived and/or modified sequence opt1 from anti-HIV_CDR
gaccgcgugggccggcgccugggggagcucagcgccggcuucgacuac

SEQ ID NO: 13932 - RNA, 48 nt, Artificial Sequence
  derived and/or modified sequence opt1 from anti-HIV_CDR
gcccgcccccggagcccgugggacuccaccggcuggagcgugggguac

SEQ ID NO: 13933 - RNA, 48 nt, Artificial Sequence
  derived and/or modified sequence opt1 from anti-HIV_CDR
agcuacuacgacuuccgcuccgacagcggcaacgacgccuucgacauc

SEQ ID NO: 13934 - RNA, 48 nt, Artificial Sequence
  derived and/or modified sequence opt1 from anti-HIV_CDR
agcuacuacgacuuccagaccgacuccggcaacgacgccuucgacgug

SEQ ID NO: 13935 - RNA, 48 nt, Artificial Sequence
  derived and/or modified sequence opt1 from anti-HIV_CDR
gacaaccccgugcugcagcucggcgagcugagcuccagccuggacuac

SEQ ID NO: 13936 - RNA, 48 nt, Artificial Sequence
  derived and/or modified sequence opt1 from anti-HIV_CDR
ggcuuccgcgggagccccuucuccagcggcuccauguacuucgacagc

SEQ ID NO: 13937 - RNA, 48 nt, Artificial Sequence
  derived and/or modified sequence opt1 from anti-HIV_CDR
ggcuuccgcgggagcccccuguccagcggcucccucuacuucgacagc

SEQ ID NO: 13938 - RNA, 48 nt, Artificial Sequence
  derived and/or modified sequence opt1 from anti-HIV_CDR
ggcuuccgcgggaacguguucagcaccggcugguucuaccuggacuuc

SEQ ID NO: 13939 - RNA, 48 nt, Artificial Sequence
  derived and/or modified sequence opt1 from anti-HIV_CDR
gaccgccugagcuucuccgugcaggucgagcagggcgugcucgacuac

SEQ ID NO: 13940 - RNA, 48 nt, Artificial Sequence
  derived and/or modified sequence opt1 from anti-HIV_CDR
gaccgccugagcuucuccgugcaggucgagcagggcgugcuccaguuc

SEQ ID NO: 13941 - RNA, 48 nt, Artificial Sequence
  derived and/or modified sequence opt1 from anti-HIV_CDR
gugcugagcggccgcaucaccaucuucuacuacuacuacauggacguc

SEQ ID NO: 13942 - RNA, 51 nt, Artificial Sequence
  derived and/or modified sequence opt1 from anti-HIV_CDR
uacaucagcuccggcagcuccacccugcacuacgccgacaccgugaagggg

SEQ ID NO: 13943 - RNA, 51 nt, Artificial Sequence
  derived and/or modified sequence opt1 from anti-HIV_CDR
cgcuaccuggacuggagccccaucggccgggacaccuacgggaccgacgug

SEQ ID NO: 13944 - RNA, 51 nt, Artificial Sequence
  derived and/or modified sequence opt1 from anti-HIV_CDR
cgcuacuucgacuggagccccuuccggcgcgacaccuacggcaccgacgug

SEQ ID NO: 13945 - RNA, 51 nt, Artificial Sequence
  derived and/or modified sequence opt1 from anti-HIV_CDR
ggccgcgacuacaacuucuggagcgggggcgggcgguacuacuucgacuuc

SEQ ID NO: 13946 - RNA, 51 nt, Artificial Sequence
  derived and/or modified sequence opt1 from anti-HIV_CDR
ggcauccaggaggacuacgacuucuggcgcgaguaccgggagcuggacuac

SEQ ID NO: 13947 - RNA, 51 nt, Artificial Sequence
  derived and/or modified sequence opt1 from anti-HIV_CDR
gugcugaacaacaacacccgcaagagcaucaacaucggccccgggcgggcc

SEQ ID NO: 13948 - RNA, 51 nt, Artificial Sequence
  derived and/or modified sequence opt1 from anti-HIV_CDR
gaccugaacuucggcguggucacccccuacuacuacuacuaccucgacgug

SEQ ID NO: 13949 - RNA, 51 nt, Artificial Sequence
  derived and/or modified sequence opt1 from anti-HIV_CDR
cacggccgcaccguguucggggucgugcggaacuacuacuacauggacgug

SEQ ID NO: 13950 - RNA, 51 nt, Artificial Sequence
  derived and/or modified sequence opt1 from anti-HIV_CDR
cacuacuacggcagcgggcugaccaaggacuacuacgaguacaucgacgug

SEQ ID NO: 13951 - RNA, 51 nt, Artificial Sequence
  derived and/or modified sequence opt1 from anti-HIV_CDR
accuacuacaacuucuggagcgaccagucccagggccuggacuucgacuac

SEQ ID NO: 13952 - RNA, 51 nt, Artificial Sequence
  derived and/or modified sequence opt1 from anti-HIV_CDR
ggcgugugggaggcccccgacgggagcuccuacuacuacuacauggccgac

SEQ ID NO: 13953 - RNA, 51 nt, Artificial Sequence
  derived and/or modified sequence opt1 from anti-HIV_CDR
gaccagggcggguaccccgugagcccggucggccccaagugguucgacccc

SEQ ID NO: 13954 - RNA, 51 nt, Artificial Sequence
  derived and/or modified sequence opt1 from anti-HIV_CDR
cgcgacaaguaccaguacaucgacagcuccggcgacuaccccuucgaccgg

SEQ ID NO: 13955 - RNA, 51 nt, Artificial Sequence
  derived and/or modified sequence opt1 from anti-HIV_CDR
cagcugcgcgcccccaccacccgguuccgccacggcggguacuucgagaac

SEQ ID NO: 13956 - RNA, 51 nt, Artificial Sequence
  derived and/or modified sequence opt1 from anti-HIV_CDR
caggugcgcgcccccacccugcgguuccgccacggcggguacuucgagacc

SEQ ID NO: 13957 - RNA, 51 nt, Artificial Sequence
  derived and/or modified sequence opt1 from anti-HIV_CDR
gugagcaucaccuacgccggccugaucgucgugcccggggccuucgacgug

SEQ ID NO: 13958 - RNA, 51 nt, Artificial Sequence
  derived and/or modified sequence opt1 from anti-HIV_CDR
guggccaucagcuacgccggccugaucgucgugcccgggccguucgacgug

SEQ ID NO: 13959 - RNA, 51 nt, Artificial Sequence
  derived and/or modified sequence opt1 from anti-HIV_CDR
agccugaccggccgccuccaccugggggagcuguccagcggcaucgggccc

SEQ ID NO: 13960 - RNA, 51 nt, Artificial Sequence
  derived and/or modified sequence opt1 from anti-HIV_CDR
ggcgggagcgcccugaucaccaucuucggcguggaccccaaguucgacccg

SEQ ID NO: 13961 - RNA, 51 nt, Artificial Sequence
  derived and/or modified sequence opt1 from anti-HIV_CDR
auggcccugaccagcggccccuacgacguguccggguacuacuucgacuac

SEQ ID NO: 13962 - RNA, 51 nt, Artificial Sequence
  derived and/or modified sequence opt1 from anti-HIV_CDR
auggcccuggccagcggccccuacgacguguccggguacuacuucgacuac

SEQ ID NO: 13963 - RNA, 51 nt, Artificial Sequence
  derived and/or modified sequence opt1 from anti-HIV_CDR
auggcccugcccagcggcccgcucgaccgcuccggguacuacuucgacgac

SEQ ID NO: 13964 - RNA, 54 nt, Artificial Sequence
  derived and/or modified sequence opt1 from anti-HIV_CDR
gugguccccauguucagcaucuucggcguggugaaggccaacuacuucgacuac

SEQ ID NO: 13965 - RNA, 54 nt, Artificial Sequence
  derived and/or modified sequence opt1 from anti-HIV_CDR
aaccgccggguggccaugcccgaggccaugauccugagcuucuacauggacguc

SEQ ID NO: 13966 - RNA, 54 nt, Artificial Sequence
  derived and/or modified sequence opt1 from anti-HIV_CDR
ggccugugccgcgggggcaacugccggcucgggcccagcggcuggcuggacccg

SEQ ID NO: 13967 - RNA, 54 nt, Artificial Sequence
  derived and/or modified sequence opt1 from anti-HIV_CDR
accccgccccacuacgacgugcugaccggcuaccccagcuccguccucgaguuc

SEQ ID NO: 13968 - RNA, 54 nt, Artificial Sequence
  derived and/or modified sequence opt1 from anti-HIV_CDR
auccccuaccacagcgaguccuacuacaagguggucaucggcggguucgacgug

SEQ ID NO: 13969 - RNA, 54 nt, Artificial Sequence
  derived and/or modified sequence opt1 from anti-HIV_CDR
gccgaccccuucaagguggcccaggacgagggccuguucgucaucuucgacuac

SEQ ID NO: 13970 - RNA, 54 nt, Artificial Sequence
  derived and/or modified sequence opt1 from anti-HIV_CDR
gccgaccccuucaagguggcccaggacgagggccuguacgucaucuucgacuac

SEQ ID NO: 13971 - RNA, 54 nt, Artificial Sequence
  derived and/or modified sequence opt1 from anti-HIV_CDR
gccgaccgcuucaagguggcccaggacgagggccuguucgucaucuucgacuac

SEQ ID NO: 13972 - RNA, 54 nt, Artificial Sequence
  derived and/or modified sequence opt1 from anti-HIV_CDR
ggccgccagaccuuccgggccaucuggagcgggcccccggccguguucgacauc

SEQ ID NO: 13973 - RNA, 54 nt, Artificial Sequence
  derived and/or modified sequence opt1 from anti-HIV_CDR
ggccgccagaccuuccgggccaucuggagcgggcccccgguggucuucgacauc

SEQ ID NO: 13974 - RNA, 54 nt, Artificial Sequence
  derived and/or modified sequence opt1 from anti-HIV_CDR
agccgcggcgacuacaacuucugguccggguaccccgaguaccacuucgaccgg

SEQ ID NO: 13975 - RNA, 54 nt, Artificial Sequence
  derived and/or modified sequence opt1 from anti-HIV_CDR
cugcccaagagccgcauggugggcggggaccaccucccguucuaccccgacuuc

SEQ ID NO: 13976 - RNA, 54 nt, Artificial Sequence
  derived and/or modified sequence opt1 from anti-HIV_CDR
cugaccggccccagcggguacugcgacuccagcggcugcuacugguucgacccg

SEQ ID NO: 13977 - RNA, 54 nt, Artificial Sequence
  derived and/or modified sequence opt1 from anti-HIV_CDR
ggcgggagcaugauccgcggcgugcccuccccguucuacuacgggauggacguc

SEQ ID NO: 13978 - RNA, 54 nt, Artificial Sequence
  derived and/or modified sequence opt1 from anti-HIV_CDR
cuguucggcgccaagcgccucgggguggcccccagcggcuacuacauggacguc

SEQ ID NO: 13979 - RNA, 54 nt, Artificial Sequence
  derived and/or modified sequence opt1 from anti-HIV_CDR
gaccgcuacgaggccgccugguucggcgcggacaagguguacgggauggacguc

SEQ ID NO: 13980 - RNA, 54 nt, Artificial Sequence
  derived and/or modified sequence opt1 from anti-HIV_CDR
gagcaccgccugcccccgcccaccggccggcgcacccggaacugguucgacccc

SEQ ID NO: 13981 - RNA, 54 nt, Artificial Sequence
  derived and/or modified sequence opt1 from anti-HIV_CDR
ggccgcgggagcuuccagggcuuccagcaguacgaguacuacgggauggacgug

SEQ ID NO: 13982 - RNA, 54 nt, Artificial Sequence
  derived and/or modified sequence opt1 from anti-HIV_CDR
ggccgcggguacagccacggcuuccagcaguacaacuacuacgggauggacgug

SEQ ID NO: 13983 - RNA, 54 nt, Artificial Sequence
  derived and/or modified sequence opt1 from anti-HIV_CDR
ggccgcgggagcuucaccggcuucgaccaguaccacuacuacgggauggacgug

SEQ ID NO: 13984 - RNA, 54 nt, Artificial Sequence
  derived and/or modified sequence opt1 from anti-HIV_CDR
ggccgcgggagcaccuuccccuccgcccaguucagcuacuucggccuggacgug

SEQ ID NO: 13985 - RNA, 54 nt, Artificial Sequence
  derived and/or modified sequence opt1 from anti-HIV_CDR
gaccuggcccgcuacggcgugaccagcaucguccccgaguucggguucgacuuc

SEQ ID NO: 13986 - RNA, 54 nt, Artificial Sequence
  derived and/or modified sequence opt1 from anti-HIV_CDR
cgcggccggcugaacauccccagcccguccgccauccucaccgccuucgacgug

SEQ ID NO: 13987 - RNA, 54 nt, Artificial Sequence
  derived and/or modified sequence opt1 from anti-HIV_CDR
ggccccgggagcauggugcgcggccugaucgucaccuccuacgggauggacgug

SEQ ID NO: 13988 - RNA, 54 nt, Artificial Sequence
  derived and/or modified sequence opt1 from anti-HIV_CDR
aagcgcgugaccaucuucggcgucguggacaccccccggggguacuucgacuac

SEQ ID NO: 13989 - RNA, 54 nt, Artificial Sequence
  derived and/or modified sequence opt1 from anti-HIV_CDR
ggccagcgcaacgugcugcacuuccucgagcggaagaacgacgccuucgacauc

SEQ ID NO: 13990 - RNA, 54 nt, Artificial Sequence
  derived and/or modified sequence opt1 from anti-HIV_CDR
gagcagaaggacuacgacuucuggaacggccuguacaaguacgggauggacgug

SEQ ID NO: 13991 - RNA, 57 nt, Artificial Sequence
  derived and/or modified sequence opt1 from anti-HIV_CDR
gacaccaccacguucaccaccuucggcgggggccccaacaugggcggguucgacccg

SEQ ID NO: 13992 - RNA, 57 nt, Artificial Sequence
  derived and/or modified sequence opt1 from anti-HIV_CDR
gccggccuggacuacaacuucuggaacgggaagggccgcaagggggccuucgacgug

SEQ ID NO: 13993 - RNA, 57 nt, Artificial Sequence
  derived and/or modified sequence opt1 from anti-HIV_CDR
aacgaggccgacuaccacgacggcaacgggcacagccugcgcggcauguucgacuac

SEQ ID NO: 13994 - RNA, 57 nt, Artificial Sequence
  derived and/or modified sequence opt1 from anti-HIV_CDR
aacgagccccaguaccacgacggcaacgggcacagccugccgggcauguucgacucc

SEQ ID NO: 13995 - RNA, 57 nt, Artificial Sequence
  derived and/or modified sequence opt1 from anti-HIV_CDR
aacgagccccaguaccacgacgacaacggccacagccugccggggaugaucgacuac

SEQ ID NO: 13996 - RNA, 57 nt, Artificial Sequence
  derived and/or modified sequence opt1 from anti-HIV_CDR
aacgagccccaguaccacgacggcaacgggcacagccugccgggcauguucgacuuc

SEQ ID NO: 13997 - RNA, 57 nt, Artificial Sequence
  derived and/or modified sequence opt1 from anti-HIV_CDR
aacgagccccaguacuucgacggcagcgggcacucccugccgggcauguucgacuac

SEQ ID NO: 13998 - RNA, 57 nt, Artificial Sequence
  derived and/or modified sequence opt1 from anti-HIV_CDR
cgcgaggccgacuaccacgacggcaacgggcacacccugcccggcauguucgacuuc

SEQ ID NO: 13999 - RNA, 57 nt, Artificial Sequence
  derived and/or modified sequence opt1 from anti-HIV_CDR
aacgagccccaguacuacgacggcagcgggcacucccugccgggcauguucgacuac

SEQ ID NO: 14000 - RNA, 57 nt, Artificial Sequence
  derived and/or modified sequence opt1 from anti-HIV_CDR
aacgagccccaguaccacgacggcaacgggcacagccugccgggcauguucgacuac

SEQ ID NO: 14001 - RNA, 57 nt, Artificial Sequence
  derived and/or modified sequence opt1 from anti-HIV_CDR
caggacagcgacuuccacgacggccacgggcacacccugcgcggcauguucgacucc

SEQ ID NO: 14002 - RNA, 57 nt, Artificial Sequence
  derived and/or modified sequence opt1 from anti-HIV_CDR
cuggacugggugcgcggcgucaugaaccucguggagaaccacuacgccauggacgug

SEQ ID NO: 14003 - RNA, 57 nt, Artificial Sequence
  derived and/or modified sequence opt1 from anti-HIV_CDR
accaacggcaccgagaucuuccgccccgggggcggggacaugcgggacaacuggcgc

SEQ ID NO: 14004 - RNA, 57 nt, Artificial Sequence
  derived and/or modified sequence opt1 from anti-HIV_CDR
gacggccgcuacagcggggacgaccaguacuacuaccacuacuacuacauggacgug

SEQ ID NO: 14005 - RNA, 57 nt, Artificial Sequence
  derived and/or modified sequence opt1 from anti-HIV_CDR
cugaccaagaaccccagccaggacuucuggggcuccuaccucuacuacuucgaggac

SEQ ID NO: 14006 - RNA, 57 nt, Artificial Sequence
  derived and/or modified sequence opt1 from anti-HIV_CDR
ggcgccaccuacuacuacgacagcuccgggcaccagagccgccgggccuucgacauc

SEQ ID NO: 14007 - RNA, 57 nt, Artificial Sequence
  derived and/or modified sequence opt1 from anti-HIV_CDR
gccuuccaggccagcauggugcgcggcgucaucguggaccccuacgggauggacgug

SEQ ID NO: 14008 - RNA, 57 nt, Artificial Sequence
  derived and/or modified sequence opt1 from anti-HIV_CDR
caccgcgccgacuacgacuucuggaacggcagcaaccugcggggguacuucgacccc

SEQ ID NO: 14009 - RNA, 57 nt, Artificial Sequence
  derived and/or modified sequence opt1 from anti-HIV_CDR
caccgcgccaacuacgacuucuggggcgggagcaaccugcggggcuacuucgacccc

SEQ ID NO: 14010 - RNA, 57 nt, Artificial Sequence
  derived and/or modified sequence opt1 from anti-HIV_CDR
ggcuuccacuucuggagcgggaccggcacccgcccccggaacugguacuucgaccug

SEQ ID NO: 14011 - RNA, 57 nt, Artificial Sequence
  derived and/or modified sequence opt1 from anti-HIV_CDR
aacuaccugaucgagagccgcuacgacgagaaggacuacuacuacgccauggacgug

SEQ ID NO: 14012 - RNA, 57 nt, Artificial Sequence
  derived and/or modified sequence opt1 from anti-HIV_CDR
agccgcggcuacgccuacgacuccgggggccacuacuuccccaccugguucgacccg

SEQ ID NO: 14013 - RNA, 57 nt, Artificial Sequence
  derived and/or modified sequence opt1 from anti-HIV_CDR
gacaccaccacguucggcgccuucgggggcagccccaacaugggcgggcuggacccg

SEQ ID NO: 14014 - RNA, 57 nt, Artificial Sequence
  derived and/or modified sequence opt1 from anti-HIV_CDR
caccugguggucgccguggccgcgggccccgacuacuucagcuacgggauggacgug

SEQ ID NO: 14015 - RNA, 57 nt, Artificial Sequence
  derived and/or modified sequence opt1 from anti-HIV_CDR
gacaccaccacguucagcuccuucggcagcccgcccaacaugggcgggcuggacccc

SEQ ID NO: 14016 - RNA, 57 nt, Artificial Sequence
  derived and/or modified sequence opt1 from anti-HIV_CDR
gacaccaccacguucggcgccuucgggggcggggccaacaugggcgggcuggacccc

SEQ ID NO: 14017 - RNA, 57 nt, Artificial Sequence
  derived and/or modified sequence opt1 from anti-HIV_CDR
gacaccaccacguucaccagcuucggcuccccgccccgcaugggcgggcuggacccc

SEQ ID NO: 14018 - RNA, 57 nt, Artificial Sequence
  derived and/or modified sequence opt1 from anti-HIV_CDR
gacaccaccacguucagcuccuucggcagcccgccccacaugggcgggcuggacccc

SEQ ID NO: 14019 - RNA, 57 nt, Artificial Sequence
  derived and/or modified sequence opt1 from anti-HIV_CDR
gaccgcgugagcgacuacgacuucugguccggcaagcggggguacggcauggacguc

SEQ ID NO: 14020 - RNA, 57 nt, Artificial Sequence
  derived and/or modified sequence opt1 from anti-HIV_CDR
gagcugagcggcgaguaccacuucugguccgggaccuaccgcuacggcguggacguc

SEQ ID NO: 14021 - RNA, 57 nt, Artificial Sequence
  derived and/or modified sequence opt1 from anti-HIV_CDR
cacggcgccagcgagaacuacgggcccggcuccuacagcgccgagcacuuccagcac

SEQ ID NO: 14022 - RNA, 57 nt, Artificial Sequence
  derived and/or modified sequence opt1 from anti-HIV_CDR
cacggcgccagcgccaacuacgggcccggcuccuacagcgcggagcacuuccagcac

SEQ ID NO: 14023 - RNA, 60 nt, Artificial Sequence
  derived and/or modified sequence opt1 from anti-HIV_CDR
cacgaggccccccgcuacagcuacgccuuccggcgcuacuaccacuacggccuggacgug

SEQ ID NO: 14024 - RNA, 60 nt, Artificial Sequence
  derived and/or modified sequence opt1 from anti-HIV_CDR
accagcaccuacgaccagugguccggccugcaccacgacggggugauggccuucagcucc

SEQ ID NO: 14025 - RNA, 60 nt, Artificial Sequence
  derived and/or modified sequence opt1 from anti-HIV_CDR
ggcgaguucgacagcuccggguucgacuacgagagcugguaccccuacuacauggacgug

SEQ ID NO: 14026 - RNA, 60 nt, Artificial Sequence
  derived and/or modified sequence opt1 from anti-HIV_CDR
ggccagaccgaccugaacgacgacuucuggagcgaguacuccacccccggguucgacuac

SEQ ID NO: 14027 - RNA, 60 nt, Artificial Sequence
  derived and/or modified sequence opt1 from anti-HIV_CDR
ggccagaccgaccugaacgacgaccucuggagcgacuacuccacccccggguucgacuac

SEQ ID NO: 14028 - RNA, 60 nt, Artificial Sequence
  derived and/or modified sequence opt1 from anti-HIV_CDR
aaccugaucgaggagagccagacccagcaggagaucaacgagcgcgaccuccuggcccug

SEQ ID NO: 14029 - RNA, 60 nt, Artificial Sequence
  derived and/or modified sequence opt1 from anti-HIV_CDR
aaccugaucgaggagagccagauccagcaggagaagaacgagaaggagcuccuggagcug

SEQ ID NO: 14030 - RNA, 60 nt, Artificial Sequence
  derived and/or modified sequence opt1 from anti-HIV_CDR
agccugaucgagaacucccagauccagcaggagaagaacgagcaggaccuccugcagcug

SEQ ID NO: 14031 - RNA, 60 nt, Artificial Sequence
  derived and/or modified sequence opt1 from anti-HIV_CDR
agccugaucgaggagucccagauccagcaggagaagaacgagaaggagcuccuggagcug

SEQ ID NO: 14032 - RNA, 60 nt, Artificial Sequence
  derived and/or modified sequence opt1 from anti-HIV_CDR
cgccugaucgaggagagccagacccagcaggagaagaacgagcaggagcuccuggagcug

SEQ ID NO: 14033 - RNA, 60 nt, Artificial Sequence
  derived and/or modified sequence opt1 from anti-HIV_CDR
agccugaucgaggagucccagacccagcaggagaagaacgagaaggagcuccuggagcug

SEQ ID NO: 14034 - RNA, 60 nt, Artificial Sequence
  derived and/or modified sequence opt1 from anti-HIV_CDR
aaccugcucgaggagagccagaaccagcaggagaagaacgagcaggagcugcuggagcuc

SEQ ID NO: 14035 - RNA, 60 nt, Artificial Sequence
  derived and/or modified sequence opt1 from anti-HIV_CDR
acccugaucgaggagagccagaaccagcaggagaagaacgagcucgagcugcuggagcuc

SEQ ID NO: 14036 - RNA, 60 nt, Artificial Sequence
  derived and/or modified sequence opt1 from anti-HIV_CDR
acccugcaggaggagagccagaaccagcaggagaagaacgagcaggagcuccuggagcug

SEQ ID NO: 14037 - RNA, 60 nt, Artificial Sequence
  derived and/or modified sequence opt1 from anti-HIV_CDR
agccugcucgaggagucccagaaccagcaggagaagaacgagcaggagcugcuggagcuc

SEQ ID NO: 14038 - RNA, 60 nt, Artificial Sequence
  derived and/or modified sequence opt1 from anti-HIV_CDR
acccugaucgaggagagccagaaccagcaggagaagaaccagcaggagcuccugcagcug

SEQ ID NO: 14039 - RNA, 60 nt, Artificial Sequence
  derived and/or modified sequence opt1 from anti-HIV_CDR
acccugaucgaggagagccagaaccagcaggagaagaacgagcaggagcuccugggccug

SEQ ID NO: 14040 - RNA, 60 nt, Artificial Sequence
  derived and/or modified sequence opt1 from anti-HIV_CDR
acccugaucgaggagagccagaaccagcaggagaagaacgagcaggagcuccuggagcug

SEQ ID NO: 14041 - RNA, 60 nt, Artificial Sequence
  derived and/or modified sequence opt1 from anti-HIV_CDR
agccugaucgaggacucccagauccagcaggagaagaacgagaaggagcuccuggagcug

SEQ ID NO: 14042 - RNA, 60 nt, Artificial Sequence
  derived and/or modified sequence opt1 from anti-HIV_CDR
agccugcucgagaagucccagacccagcaggagaagaacgagcaggagcugcuggagcuc

SEQ ID NO: 14043 - RNA, 60 nt, Artificial Sequence
  derived and/or modified sequence opt1 from anti-HIV_CDR
agccugaucgaggagucccagaaccagcaggagaagaacgagcaggagcuccuggagcug

SEQ ID NO: 14044 - RNA, 60 nt, Artificial Sequence
  derived and/or modified sequence opt1 from anti-HIV_CDR
ggcgaccugcucggguacaccgacagcugguacgaguucgacuacuacuacauggacgug

SEQ ID NO: 14045 - RNA, 60 nt, Artificial Sequence
  derived and/or modified sequence opt1 from anti-HIV_CDR
gacaccaacggcaccgagaucuuccgccccgggggcggggacaugcgggacaacuggcgc

SEQ ID NO: 14046 - RNA, 60 nt, Artificial Sequence
  derived and/or modified sequence opt1 from anti-HIV_CDR
gacguggucgagcgccccggcuucggggacuuccgguacgacuacuacggcauggacgug

SEQ ID NO: 14047 - RNA, 60 nt, Artificial Sequence
  derived and/or modified sequence opt1 from anti-HIV_CDR
gaccagcgcgacugcagcaccaaccggugcuucggcguguucggguacuacauggacguc

SEQ ID NO: 14048 - RNA, 60 nt, Artificial Sequence
  derived and/or modified sequence opt1 from anti-HIV_CDR
gaccgcugggugcggccccaguucccgagcauggacuuccaguacaacggccuggacguc

SEQ ID NO: 14049 - RNA, 60 nt, Artificial Sequence
  derived and/or modified sequence opt1 from anti-HIV_CDR
gacagcggcuucgaccuggacuacuacgacaccaacgagcucuacuucggguucgacuac

SEQ ID NO: 14050 - RNA, 60 nt, Artificial Sequence
  derived and/or modified sequence opt1 from anti-HIV_CDR
aaguaccccgccuacuacgacauccugaccgccaacuaccgcagcuacuacuucgacuac

SEQ ID NO: 14051 - RNA, 60 nt, Artificial Sequence
  derived and/or modified sequence opt1 from anti-HIV_CDR
aaguaccccgccuacuacgacauccugaccggcuacuaccgcaacuacuacuucgacuac

SEQ ID NO: 14052 - RNA, 60 nt, Artificial Sequence
  derived and/or modified sequence opt1 from anti-HIV_CDR
cgcgugaaguucccccugugguucggcgagaccaccuacuacuacuacgggauggacguc

SEQ ID NO: 14053 - RNA, 60 nt, Artificial Sequence
  derived and/or modified sequence opt1 from anti-HIV_CDR
gagcgcagcaccaaguacuccuucuggagcgccgugaugcggcccgacgccuucgaccug

SEQ ID NO: 14054 - RNA, 60 nt, Artificial Sequence
  derived and/or modified sequence opt1 from anti-HIV_CDR
cacgaggccccccgcuacagcuacgccuuccggaacuacuaccacuacggccuggacgug

SEQ ID NO: 14055 - RNA, 60 nt, Artificial Sequence
  derived and/or modified sequence opt1 from anti-HIV_CDR
gagaacgugcugauggagagcgacgacuacaacgacuacuacuacuacuacauggacguc

SEQ ID NO: 14056 - RNA, 60 nt, Artificial Sequence
  derived and/or modified sequence opt1 from anti-HIV_CDR
gagcgcgugcuggucuuccccgaccaggacgccgacuacuacuacuacuucuucgacgug

SEQ ID NO: 14057 - RNA, 60 nt, Artificial Sequence
  derived and/or modified sequence opt1 from anti-HIV_CDR
gagcgcgugcuggucgugcccgaccaggacgccgacuacuacuacuacuucuucgacgug

SEQ ID NO: 14058 - RNA, 63 nt, Artificial Sequence
  derived and/or modified sequence opt1 from anti-HIV_CDR
gaccgcagcuccgccaucggcuacugcagcuccaucagcugcuacaagggguccuucgacauc

SEQ ID NO: 14059 - RNA, 63 nt, Artificial Sequence
  derived and/or modified sequence opt1 from anti-HIV_CDR
guggucaagaucgagccccugggcguggccccgaccaaggccaagcgcguggcgcgggagaag

SEQ ID NO: 14060 - RNA, 63 nt, Artificial Sequence
  derived and/or modified sequence opt1 from anti-HIV_CDR
gugguccgcaucgagccccugggcguggccccgaccaaggccaagcggguggagcgcgagaag

SEQ ID NO: 14061 - RNA, 63 nt, Artificial Sequence
  derived and/or modified sequence opt1 from anti-HIV_CDR
gugguccgcaucgagccccugggcaucgccccgacccgggccaagcgcguggagcgggagaag

SEQ ID NO: 14062 - RNA, 63 nt, Artificial Sequence
  derived and/or modified sequence opt1 from anti-HIV_CDR
guggucaagaucgagcccaucggcguggccccgaccaaggcccgccggguggagcgcgagaag

SEQ ID NO: 14063 - RNA, 63 nt, Artificial Sequence
  derived and/or modified sequence opt1 from anti-HIV_CDR
guggucaagaucgagccccugggcguggccccgacccgcgccaagcggguggagcgcgagaag

SEQ ID NO: 14064 - RNA, 63 nt, Artificial Sequence
  derived and/or modified sequence opt1 from anti-HIV_CDR
gugguccagaucgagccccugggcguggccccgacccgcgccaagcggguggagcgcgagaag

SEQ ID NO: 14065 - RNA, 63 nt, Artificial Sequence
  derived and/or modified sequence opt1 from anti-HIV_CDR
gugguccgcaucgagccccugggcguggccccgaccaaggccaagcgggugcagcgcgagaag

SEQ ID NO: 14066 - RNA, 63 nt, Artificial Sequence
  derived and/or modified sequence opt1 from anti-HIV_CDR
guggucaagaucgagccccugggcguggccccgaccaaggccaagcgcgugcagcggaagaag

SEQ ID NO: 14067 - RNA, 63 nt, Artificial Sequence
  derived and/or modified sequence opt1 from anti-HIV_CDR
gugaucaagaucgagccccugaucgucgccccgaccaaggccaagcgcgugcagcgggagaag

SEQ ID NO: 14068 - RNA, 63 nt, Artificial Sequence
  derived and/or modified sequence opt1 from anti-HIV_CDR
guggucaagaucgagccccugggcguggccccgaccaaggcccgccgggugcagcgcgagaag

SEQ ID NO: 14069 - RNA, 63 nt, Artificial Sequence
  derived and/or modified sequence opt1 from anti-HIV_CDR
guggucaagaucgagcugcucggcguggcccccaccaaggccaagcgcgugcagcgggagaag

SEQ ID NO: 14070 - RNA, 63 nt, Artificial Sequence
  derived and/or modified sequence opt1 from anti-HIV_CDR
guggucaccaucgagccccugggcguggccccgaccaaggccaagcgcgugcagcgggagaag

SEQ ID NO: 14071 - RNA, 63 nt, Artificial Sequence
  derived and/or modified sequence opt1 from anti-HIV_CDR
guggucaagaucgagccccugggcguggccccgaccaaggccaagcgcgugcagcgggagaag

SEQ ID NO: 14072 - RNA, 63 nt, Artificial Sequence
  derived and/or modified sequence opt1 from anti-HIV_CDR
gaccuggugagcgucuccccgcccuacggcaacuacgggcccgacaacaacugguucgacuuc

SEQ ID NO: 14073 - RNA, 63 nt, Artificial Sequence
  derived and/or modified sequence opt1 from anti-HIV_CDR
augaacccgcccugguuccgcggcgggagcaacaaccccuacuccuacuacuacauggacgug

SEQ ID NO: 14074 - RNA, 63 nt, Artificial Sequence
  derived and/or modified sequence opt1 from anti-HIV_CDR
gacuggaucggcuacgacuacgacgggagcggcucccaccugcgcgacgagagcuucgacauc

SEQ ID NO: 14075 - RNA, 63 nt, Artificial Sequence
  derived and/or modified sequence opt1 from anti-HIV_CDR
ugcagcaucgugggcaacggggacuuccuggaggaggacucccacuaccccgccauggacguc

SEQ ID NO: 14076 - RNA, 63 nt, Artificial Sequence
  derived and/or modified sequence opt1 from anti-HIV_CDR
gacuucgugagcaucuacggcgucgccuacuucaccgggggcgggcccuccagcccggacauc

SEQ ID NO: 14077 - RNA, 66 nt, Artificial Sequence
  derived and/or modified sequence opt1 from anti-HIV_CDR
aaggccaaggacuacuacuacgagagcuccgacuacagccccuacuacuacuacuacauggacgug

SEQ ID NO: 14078 - RNA, 66 nt, Artificial Sequence
  derived and/or modified sequence opt1 from anti-HIV_CDR
gaccacggcaucaagcccgacaacuacuacgacaucagcggguacaaccuggacuacuucgacuac

SEQ ID NO: 14079 - RNA, 66 nt, Artificial Sequence
  derived and/or modified sequence opt1 from anti-HIV_CDR
ggcagccuguacgacuaccgcgacaacgccgaccucaagcccuccuacuacuacgccauggacgug

SEQ ID NO: 14080 - RNA, 66 nt, Artificial Sequence
  derived and/or modified sequence opt1 from anti-HIV_CDR
gacgaggccagcuggguggaggccgcggacgagugggacgagcaccuguuccgcgagauggccguc

SEQ ID NO: 14081 - RNA, 66 nt, Artificial Sequence
  derived and/or modified sequence opt1 from anti-HIV_CDR
gacgaggugagcugggucgaggccgccgacgagugggacgagcaccuguuccgcgagauggcggug

SEQ ID NO: 14082 - RNA, 66 nt, Artificial Sequence
  derived and/or modified sequence opt1 from anti-HIV_CDR
gacgagggcagcuggguggaggccgccgacgagugggacgagcaccuguuccgcgagauggcgguc

SEQ ID NO: 14083 - RNA, 66 nt, Artificial Sequence
  derived and/or modified sequence opt1 from anti-HIV_CDR
gaccagcgcggccgguacagcuucggguucgugaccggccagaccaaggucuccgccaucagcgac

SEQ ID NO: 14084 - RNA, 66 nt, Artificial Sequence
  derived and/or modified sequence opt1 from anti-HIV_CDR
gaccagcugggccgcuacagcuucggguucgugaccggccagaacaaggucuccgccaucagcgac

SEQ ID NO: 14085 - RNA, 66 nt, Artificial Sequence
  derived and/or modified sequence opt1 from anti-HIV_CDR
gaccaggugggccgcuacagcuucggguucgccaccggccagcagcgggucuccgccaucagcgac

SEQ ID NO: 14086 - RNA, 69 nt, Artificial Sequence
  derived and/or modified sequence opt1 from anti-HIV_CDR
guggucaagaucgagccccugggcguggccccgaccaaggccaagcgccgggugguccagcgcgagaag

SEQ ID NO: 14087 - RNA, 69 nt, Artificial Sequence
  derived and/or modified sequence opt1 from anti-HIV_CDR
cgcaucagcuccagcuccugguacaugguggacaacagccacacccugcacuucuacuacauggacguc

SEQ ID NO: 14088 - RNA, 69 nt, Artificial Sequence
  derived and/or modified sequence opt1 from anti-HIV_CDR
gacaagcccgccuacgacgaguacgccgaggagaccaucgcgccgcacaacuaccacgccauggaccug

SEQ ID NO: 14089 - RNA, 69 nt, Artificial Sequence
  derived and/or modified sequence opt1 from anti-HIV_CDR
cagaacaucgccgcccgcgcggccgagaagcuguacgagaacgacuacuacuucuacggcauggacgug

SEQ ID NO: 14090 - RNA, 69 nt, Artificial Sequence
  derived and/or modified sequence opt1 from anti-HIV_CDR
cagaacaucgccgcccgcaccgcggagcggcuguacgagaacgacuacuacuucuacggcauggacgug

SEQ ID NO: 14091 - RNA, 72 nt, Artificial Sequence
  derived and/or modified sequence opt1 from anti-HIV_CDR
gcccagcagggcaagcgcaucuacgggaucgugagcuucggcgaguucuucuacuacuacuacauggacgcc

SEQ ID NO: 14092 - RNA, 72 nt, Artificial Sequence
  derived and/or modified sequence opt1 from anti-HIV_CDR
acccagcagggcaagcgcaucuacgggguggucagcuucggcgaguucuuccacuacuacuacauggacgcc

SEQ ID NO: 14093 - RNA, 72 nt, Artificial Sequence
  derived and/or modified sequence opt1 from anti-HIV_CDR
gcccgccggggccagcgcaucuacgggguggucagcuucggcgaguucuucuacuacuacuccauggacgug

SEQ ID NO: 14094 - RNA, 72 nt, Artificial Sequence
  derived and/or modified sequence opt1 from anti-HIV_CDR
acccugcacggccgccggaucuacgggaucguggccuucaacgagugguucaccuacuucuacauggacguc

SEQ ID NO: 14095 - RNA, 72 nt, Artificial Sequence
  derived and/or modified sequence opt1 from anti-HIV_CDR
accaagcacggccgccggaucuacgggaucguggccuucaacgagugguucaccuacuucuacauggacguc

SEQ ID NO: 14096 - RNA, 72 nt, Artificial Sequence
  derived and/or modified sequence opt1 from anti-HIV_CDR
gcccgccacggccagcggaucuacgggguggucagcuucggcgaguucuucaccuacuacuccauggacgug

SEQ ID NO: 14097 - RNA, 72 nt, Artificial Sequence
  derived and/or modified sequence opt1 from anti-HIV_CDR
acccagcagggcaagcgcaucuacgggguggucagcuucggcgacuacuacuacuacuacuacauggacgug

SEQ ID NO: 14098 - RNA, 72 nt, Artificial Sequence
  derived and/or modified sequence opt1 from anti-HIV_CDR
accaagcacggccgccggaucuacgggguggucgccuucggcgagugguucaccuacuucuacauggacgug

SEQ ID NO: 14099 - RNA, 72 nt, Artificial Sequence
  derived and/or modified sequence opt1 from anti-HIV_CDR
gccgugaucaccgaccugcacaccuucggcgacuacgagcucgaggaccccagcuacuacuacauggacguc

SEQ ID NO: 14100 - RNA, 72 nt, Artificial Sequence
  derived and/or modified sequence opt1 from anti-HIV_CDR
gaccgcggcgacacccggcugcucgacuacggggacuacgaggacgagcgcuacuacuacggcauggacgug

SEQ ID NO: 14101 - RNA, 72 nt, Artificial Sequence
  derived and/or modified sequence opt1 from anti-HIV_CDR
ggcacccgcuacgacuucuggagcggguucuccaaccgggacggccgcgcccuggccggguacuucgacuac

SEQ ID NO: 14102 - RNA, 72 nt, Artificial Sequence
  derived and/or modified sequence opt1 from anti-HIV_CDR
gacggcaaggggaaggccuacuacgacuucuggagcggcuaccgcaaccagaaguacuacgggcuggacgug

SEQ ID NO: 14103 - RNA, 72 nt, Artificial Sequence
  derived and/or modified sequence opt1 from anti-HIV_CDR
gccgugaucaccgaccugcacaccuucgccgacuacgagcucggcgaccccagcuacuucuacauggacguc

SEQ ID NO: 14104 - RNA, 72 nt, Artificial Sequence
  derived and/or modified sequence opt1 from anti-HIV_CDR
agcgugaucaccgaccugcacaccuucggcgacuacgaguccggggaccccagcuacuacuacauggacguc

SEQ ID NO: 14105 - RNA, 81 nt, Artificial Sequence
  derived and/or modified sequence opt1 from anti-HIV_CDR
gacuucccccgcuuccaccggcuggugggcaacuacgacuucuggcgcgggacccucgaccgguucagcuacauggaccug

SEQ ID NO: 14106 - RNA, 105 nt, Artificial Sequence
  derived and/or modified sequence opt1 from anti-HIV_CDR
cgcauccuggccguggagcgguaccucaaggaccagcagcugcugggcaucugggggugcagcggcaagaucaucugccccaccauggucccguggaacuccagc

SEQ ID NO: 14107 - RNA, 105 nt, Artificial Sequence
  derived and/or modified sequence opt1 from anti-HIV_CDR
cgcgugcuggccgucgagcgguaccuccaggaccagcgccugcugggcaugugggggugcagcggcaagcacaucugcaccaccuucgugcccuggaacuccagc

SEQ ID NO: 14108 - RNA, 105 nt, Artificial Sequence
  derived and/or modified sequence opt1 from anti-HIV_CDR
cgcgugcuggccgucgagagcuaccucaaggaccagcagcugcugggcaucugggggugcuccggcaagcacaucugcaccaccacggugcccuggaacagcucc

SEQ ID NO: 14109 - RNA, 105 nt, Artificial Sequence
  derived and/or modified sequence opt1 from anti-HIV_CDR
cgcgugcuggccgucgagcgguaccuccgcgaccagcagcugcugggcaucugggggugcagcggccggcacaucugcaccaccaacgugcccuggaacuccagc

SEQ ID NO: 14110 - RNA, 105 nt, Artificial Sequence
  derived and/or modified sequence opt1 from anti-HIV_CDR
cgcauccuggccguggagcgguaccucaaggaccagcagcugcugggcaucugggggugcagcggcaagcucaucugcaccaccacgguccccuggaacuccagc

SEQ ID NO: 14111 - RNA, 105 nt, Artificial Sequence
  derived and/or modified sequence opt1 from anti-HIV_CDR
cgcauccuggccguggagcgguaccucaaggaccagcagcugcugggcaucugggggugcagcggcaagcacaucugcaccaccaacguccccuggaacuccagc

SEQ ID NO: 14112 - RNA, 105 nt, Artificial Sequence
  derived and/or modified sequence opt1 from anti-HIV_CDR
cgcgugcuggccgucgagcgguaccuccgcgaccagcagcugcugggcaucugggggugcagcggcaagcucaucugcaccaccacggugcccuggaacgccucc

SEQ ID NO: 14113 - RNA, 105 nt, Artificial Sequence
  derived and/or modified sequence opt1 from anti-HIV_CDR
cgcgugcuggccgucgagcgguaccuccgcgaccagcagcugcugggcaucugggggugcagcggcaagcucaucugcaccaccgccgugcccuggaacgcgucc

SEQ ID NO: 14114 - RNA, 105 nt, Artificial Sequence
  derived and/or modified sequence opt1 from anti-HIV_CDR
cgcgugcuggccgucgagcgguaccucaaggaccagcagcugcugggcaucugggggugcagcggcaagcucaucugcaccaccacggugcccuggaacgccucc

SEQ ID NO: 14115 - RNA, 105 nt, Artificial Sequence
  derived and/or modified sequence opt1 from anti-HIV_CDR
cgcauccuggccguggagcgguaccucaaggaccagcagcugcugggcuucugggggugcagcggcaagcucaucugcaccaccgccguccccuggaacgcgucc

SEQ ID NO: 14116 - RNA, 105 nt, Artificial Sequence
  derived and/or modified sequence opt1 from anti-HIV_CDR
cgcgugcuggccgucgagcgguaccuccgcgaccagcagcugcugggcaucugggggugcagcggcaagcucaucugcaccaccacggugcccuggaacaccucc

SEQ ID NO: 14117 - RNA, 105 nt, Artificial Sequence
  derived and/or modified sequence opt1 from anti-HIV_CDR
cgcgugcuggccgucgagcgguaccucaaggaccagcagcugcugggcaucugggggugcagcggcaagcucaucugcaccaccgccgugcccuggaacgcgucc

SEQ ID NO: 14118 - RNA, 105 nt, Artificial Sequence
  derived and/or modified sequence opt1 from anti-HIV_CDR
cgcgugcuggccgucgagcgguaccucaaggaccagcagcugcugggcuucugggggugcagcggcaagcucaucugcaccaccacggugcccuggaacgccucc

SEQ ID NO: 14119 - RNA, 105 nt, Artificial Sequence
  derived and/or modified sequence opt1 from anti-HIV_CDR
cgcauccuggccguggagcgguaccucaaggaccagcagcugcugggcaucugggggugcagcggcaagcucaucugcaccaccgccguccccuggaacgcgucc

SEQ ID NO: 14120-14145 - skipped (26 entries)

SEQ ID NO: 14146 - RNA, 12 nt, Artificial Sequence
  derived and/or modified sequence opt1 from anti-influenza_CDR
gacgugcccgac

SEQ ID NO: 14147 - RNA, 12 nt, Artificial Sequence
  derived and/or modified sequence opt1 from anti-influenza_CDR
cgccugagcggc

SEQ ID NO: 14148 - RNA, 12 nt, Artificial Sequence
  derived and/or modified sequence opt1 from anti-influenza_CDR
uucugggaccug

SEQ ID NO: 14149 - RNA, 15 nt, Artificial Sequence
  derived and/or modified sequence opt1 from anti-influenza_CDR
accggccugcgcaac

SEQ ID NO: 14150 - RNA, 15 nt, Artificial Sequence
  derived and/or modified sequence opt1 from anti-influenza_CDR
cagcagagccgcacc

SEQ ID NO: 14151 - RNA, 15 nt, Artificial Sequence
  derived and/or modified sequence opt1 from anti-influenza_CDR
cagcugagccgcacc

SEQ ID NO: 14152 - RNA, 15 nt, Artificial Sequence
  derived and/or modified sequence opt1 from anti-influenza_CDR
agcaacuacaucacc

SEQ ID NO: 14153 - RNA, 15 nt, Artificial Sequence
  derived and/or modified sequence opt1 from anti-influenza_CDR
gacuacagcuggaac

SEQ ID NO: 14154 - RNA, 15 nt, Artificial Sequence
  derived and/or modified sequence opt1 from anti-influenza_CDR
aacuacgccuucagc

SEQ ID NO: 14155 - RNA, 15 nt, Artificial Sequence
  derived and/or modified sequence opt1 from anti-influenza_CDR
aagaacgccaucagc

SEQ ID NO: 14156 - RNA, 15 nt, Artificial Sequence
  derived and/or modified sequence opt1 from anti-influenza_CDR
agccacuggaugacc

SEQ ID NO: 14157 - RNA, 15 nt, Artificial Sequence
  derived and/or modified sequence opt1 from anti-influenza_CDR
aacuacgacaucaac

SEQ ID NO: 14158 - RNA, 15 nt, Artificial Sequence
  derived and/or modified sequence opt1 from anti-influenza_CDR
gacuacggcgugacc

SEQ ID NO: 14159 - RNA, 15 nt, Artificial Sequence
  derived and/or modified sequence opt1 from anti-influenza_CDR
aacuacggcaucaac

SEQ ID NO: 14160 - RNA, 15 nt, Artificial Sequence
  derived and/or modified sequence opt1 from anti-influenza_CDR
ggcuacaccaucacc

SEQ ID NO: 14161 - RNA, 15 nt, Artificial Sequence
  derived and/or modified sequence opt1 from anti-influenza_CDR
aacuacggcaucagc

SEQ ID NO: 14162 - RNA, 15 nt, Artificial Sequence
  derived and/or modified sequence opt1 from anti-influenza_CDR
gacgacuacuggacc

SEQ ID NO: 14163 - RNA, 15 nt, Artificial Sequence
  derived and/or modified sequence opt1 from anti-influenza_CDR
accuacgccaugcac

SEQ ID NO: 14164 - RNA, 15 nt, Artificial Sequence
  derived and/or modified sequence opt1 from anti-influenza_CDR
agcuacgccaugcac

SEQ ID NO: 14165 - RNA, 15 nt, Artificial Sequence
  derived and/or modified sequence opt1 from anti-influenza_CDR
agcuacuacuggaac

SEQ ID NO: 14166 - RNA, 15 nt, Artificial Sequence
  derived and/or modified sequence opt1 from anti-influenza_CDR
accuaccccguggcc

SEQ ID NO: 14167 - RNA, 15 nt, Artificial Sequence
  derived and/or modified sequence opt1 from anti-influenza_CDR
cacuacuucuggagc

SEQ ID NO: 14168 - RNA, 15 nt, Artificial Sequence
  derived and/or modified sequence opt1 from anti-influenza_CDR
gacuacuacuggacc

SEQ ID NO: 14169 - RNA, 15 nt, Artificial Sequence
  derived and/or modified sequence opt1 from anti-influenza_CDR
gacuacuacuggagc

SEQ ID NO: 14170 - RNA, 15 nt, Artificial Sequence
  derived and/or modified sequence opt1 from anti-influenza_CDR
ggcuacuacaugcac

SEQ ID NO: 14171 - RNA, 15 nt, Artificial Sequence
  derived and/or modified sequence opt1 from anti-influenza_CDR
agccacuacuggucc

SEQ ID NO: 14172 - RNA, 15 nt, Artificial Sequence
  derived and/or modified sequence opt1 from anti-influenza_CDR
aacuacuggaucggc

SEQ ID NO: 14173 - RNA, 15 nt, Artificial Sequence
  derived and/or modified sequence opt1 from anti-influenza_CDR
aacuacgccaucauc

SEQ ID NO: 14174 - RNA, 15 nt, Artificial Sequence
  derived and/or modified sequence opt1 from anti-influenza_CDR
gacuacuacauccac

SEQ ID NO: 14175 - RNA, 15 nt, Artificial Sequence
  derived and/or modified sequence opt1 from anti-influenza_CDR
ggcuacgacaugcac

SEQ ID NO: 14176 - RNA, 15 nt, Artificial Sequence
  derived and/or modified sequence opt1 from anti-influenza_CDR
ggcuacuacauccac

SEQ ID NO: 14177 - RNA, 15 nt, Artificial Sequence
  derived and/or modified sequence opt1 from anti-influenza_CDR
ggcuacuacgugcac

SEQ ID NO: 14178 - RNA, 15 nt, Artificial Sequence
  derived and/or modified sequence opt1 from anti-influenza_CDR
aacuacuggaugagc

SEQ ID NO: 14179 - RNA, 15 nt, Artificial Sequence
  derived and/or modified sequence opt1 from anti-influenza_CDR
ggcgagagcacccug

SEQ ID NO: 14180 - RNA, 15 nt, Artificial Sequence
  derived and/or modified sequence opt1 from anti-influenza_CDR
aacuacuacuggagc

SEQ ID NO: 14181 - RNA, 15 nt, Artificial Sequence
  derived and/or modified sequence opt1 from anti-influenza_CDR
agcaacuacaugucc

SEQ ID NO: 14182 - RNA, 15 nt, Artificial Sequence
  derived and/or modified sequence opt1 from anti-influenza_CDR
agcgacuacuggucc

SEQ ID NO: 14183 - RNA, 15 nt, Artificial Sequence
  derived and/or modified sequence opt1 from anti-influenza_CDR
agcuacaacuggauc

SEQ ID NO: 14184 - RNA, 15 nt, Artificial Sequence
  derived and/or modified sequence opt1 from anti-influenza_CDR
agcaccuacaugaac

SEQ ID NO: 14185 - RNA, 15 nt, Artificial Sequence
  derived and/or modified sequence opt1 from anti-influenza_CDR
aacuacgccaugagc

SEQ ID NO: 14186 - RNA, 15 nt, Artificial Sequence
  derived and/or modified sequence opt1 from anti-influenza_CDR
agcgacuucuggucc

SEQ ID NO: 14187 - RNA, 15 nt, Artificial Sequence
  derived and/or modified sequence opt1 from anti-influenza_CDR
uacuacgccaugagc

SEQ ID NO: 14188 - RNA, 15 nt, Artificial Sequence
  derived and/or modified sequence opt1 from anti-influenza_CDR
ggcuacuacguguac

SEQ ID NO: 14189 - RNA, 15 nt, Artificial Sequence
  derived and/or modified sequence opt1 from anti-influenza_CDR
agcuacgccaucucc

SEQ ID NO: 14190 - RNA, 15 nt, Artificial Sequence
  derived and/or modified sequence opt1 from anti-influenza_CDR
agcuacuccuggagc

SEQ ID NO: 14191 - RNA, 15 nt, Artificial Sequence
  derived and/or modified sequence opt1 from anti-influenza_CDR
aacagcuucuggggc

SEQ ID NO: 14192 - RNA, 15 nt, Artificial Sequence
  derived and/or modified sequence opt1 from anti-influenza_CDR
gccuaccacuggagc

SEQ ID NO: 14193 - RNA, 15 nt, Artificial Sequence
  derived and/or modified sequence opt1 from anti-influenza_CDR
gacaacuacaucaac

SEQ ID NO: 14194 - RNA, 15 nt, Artificial Sequence
  derived and/or modified sequence opt1 from anti-influenza_CDR
agcggcuucuccgug

SEQ ID NO: 14195 - RNA, 15 nt, Artificial Sequence
  derived and/or modified sequence opt1 from anti-influenza_CDR
gccuacgccuucacc

SEQ ID NO: 14196 - RNA, 15 nt, Artificial Sequence
  derived and/or modified sequence opt1 from anti-influenza_CDR
ggcagcgccaucucc

SEQ ID NO: 14197 - RNA, 15 nt, Artificial Sequence
  derived and/or modified sequence opt1 from anti-influenza_CDR
agcuacgccaucacc

SEQ ID NO: 14198 - RNA, 15 nt, Artificial Sequence
  derived and/or modified sequence opt1 from anti-influenza_CDR
agcuacuacaugcac

SEQ ID NO: 14199 - RNA, 15 nt, Artificial Sequence
  derived and/or modified sequence opt1 from anti-influenza_CDR
aucuacgccaugagc

SEQ ID NO: 14200 - RNA, 15 nt, Artificial Sequence
  derived and/or modified sequence opt1 from anti-influenza_CDR
agcuacuccaugaac

SEQ ID NO: 14201 - RNA, 15 nt, Artificial Sequence
  derived and/or modified sequence opt1 from anti-influenza_CDR
agcuacggcaucucc

SEQ ID NO: 14202 - RNA, 15 nt, Artificial Sequence
  derived and/or modified sequence opt1 from anti-influenza_CDR
uucuacagcaugucc

SEQ ID NO: 14203 - RNA, 15 nt, Artificial Sequence
  derived and/or modified sequence opt1 from anti-influenza_CDR
acccacgccaucagc

SEQ ID NO: 14204 - RNA, 15 nt, Artificial Sequence
  derived and/or modified sequence opt1 from anti-influenza_CDR
ggcuacgccaucagc

SEQ ID NO: 14205 - RNA, 15 nt, Artificial Sequence
  derived and/or modified sequence opt1 from anti-influenza_CDR
agcaacuccaucagc

SEQ ID NO: 14206 - RNA, 15 nt, Artificial Sequence
  derived and/or modified sequence opt1 from anti-influenza_CDR
aacuucgccaucaac

SEQ ID NO: 14207 - RNA, 15 nt, Artificial Sequence
  derived and/or modified sequence opt1 from anti-influenza_CDR
agcaacgccgugucc

SEQ ID NO: 14208 - RNA, 15 nt, Artificial Sequence
  derived and/or modified sequence opt1 from anti-influenza_CDR
gacaacgccaucagc

SEQ ID NO: 14209 - RNA, 15 nt, Artificial Sequence
  derived and/or modified sequence opt1 from anti-influenza_CDR
uucagcgagguggag

SEQ ID NO: 14210 - RNA, 15 nt, Artificial Sequence
  derived and/or modified sequence opt1 from anti-influenza_CDR
gcccaccacaugcac

SEQ ID NO: 14211 - RNA, 15 nt, Artificial Sequence
  derived and/or modified sequence opt1 from anti-influenza_CDR
agccaguggaucggc

SEQ ID NO: 14212 - RNA, 15 nt, Artificial Sequence
  derived and/or modified sequence opt1 from anti-influenza_CDR
gacuacgccaugaac

SEQ ID NO: 14213 - RNA, 15 nt, Artificial Sequence
  derived and/or modified sequence opt1 from anti-influenza_CDR
aacgccuggaugagc

SEQ ID NO: 14214 - RNA, 15 nt, Artificial Sequence
  derived and/or modified sequence opt1 from anti-influenza_CDR
gacuacgccaucaac

SEQ ID NO: 14215 - RNA, 15 nt, Artificial Sequence
  derived and/or modified sequence opt1 from anti-influenza_CDR
cgccacggcaucagc

SEQ ID NO: 14216 - RNA, 15 nt, Artificial Sequence
  derived and/or modified sequence opt1 from anti-influenza_CDR
gagcugagcauccac

SEQ ID NO: 14217 - RNA, 15 nt, Artificial Sequence
  derived and/or modified sequence opt1 from anti-influenza_CDR
agcuccaacuacuac

SEQ ID NO: 14218 - RNA, 15 nt, Artificial Sequence
  derived and/or modified sequence opt1 from anti-influenza_CDR
accuacgccaugagc

SEQ ID NO: 14219 - RNA, 15 nt, Artificial Sequence
  derived and/or modified sequence opt1 from anti-influenza_CDR
aacuacgccaucagc

SEQ ID NO: 14220 - RNA, 18 nt, Artificial Sequence
  derived and/or modified sequence opt1 from anti-influenza_CDR
uucggcgccaucgccggg

SEQ ID NO: 14221 - RNA, 18 nt, Artificial Sequence
  derived and/or modified sequence opt1 from anti-influenza_CDR
caggacaucagccgcuac

SEQ ID NO: 14222 - RNA, 18 nt, Artificial Sequence
  derived and/or modified sequence opt1 from anti-influenza_CDR
cagaacaucggccccugg

SEQ ID NO: 14223 - RNA, 18 nt, Artificial Sequence
  derived and/or modified sequence opt1 from anti-influenza_CDR
cagagcgugaaccgccgg

SEQ ID NO: 14224 - RNA, 18 nt, Artificial Sequence
  derived and/or modified sequence opt1 from anti-influenza_CDR
cagagcaucuccaccuac

SEQ ID NO: 14225 - RNA, 18 nt, Artificial Sequence
  derived and/or modified sequence opt1 from anti-influenza_CDR
cagggcaucaucaccuac

SEQ ID NO: 14226 - RNA, 18 nt, Artificial Sequence
  derived and/or modified sequence opt1 from anti-influenza_CDR
cagggcaucagcuccuac

SEQ ID NO: 14227 - RNA, 18 nt, Artificial Sequence
  derived and/or modified sequence opt1 from anti-influenza_CDR
caggacgugagcaccugg

SEQ ID NO: 14228 - RNA, 18 nt, Artificial Sequence
  derived and/or modified sequence opt1 from anti-influenza_CDR
caggacaucuacaucuac

SEQ ID NO: 14229 - RNA, 18 nt, Artificial Sequence
  derived and/or modified sequence opt1 from anti-influenza_CDR
gagaacaucuggaacaac

SEQ ID NO: 14230 - RNA, 18 nt, Artificial Sequence
  derived and/or modified sequence opt1 from anti-influenza_CDR
ggcuucaccgugaccagc

SEQ ID NO: 14231 - RNA, 18 nt, Artificial Sequence
  derived and/or modified sequence opt1 from anti-influenza_CDR
caggacaucagcggccac

SEQ ID NO: 14232 - RNA, 18 nt, Artificial Sequence
  derived and/or modified sequence opt1 from anti-influenza_CDR
agccugcucaccgaggug

SEQ ID NO: 14233 - RNA, 18 nt, Artificial Sequence
  derived and/or modified sequence opt1 from anti-influenza_CDR
ggcagcuccaucagcaac

SEQ ID NO: 14234 - RNA, 18 nt, Artificial Sequence
  derived and/or modified sequence opt1 from anti-influenza_CDR
ggcgggagcaucaccucc

SEQ ID NO: 14235 - RNA, 18 nt, Artificial Sequence
  derived and/or modified sequence opt1 from anti-influenza_CDR
ggcgggagcaucuccagc

SEQ ID NO: 14236 - RNA, 18 nt, Artificial Sequence
  derived and/or modified sequence opt1 from anti-influenza_CDR
ggccugagcguguccagc

SEQ ID NO: 14237 - RNA, 18 nt, Artificial Sequence
  derived and/or modified sequence opt1 from anti-influenza_CDR
ggcgccagcaucuccagc

SEQ ID NO: 14238 - RNA, 18 nt, Artificial Sequence
  derived and/or modified sequence opt1 from anti-influenza_CDR
ggcgacagcaucuccagc

SEQ ID NO: 14239 - RNA, 18 nt, Artificial Sequence
  derived and/or modified sequence opt1 from anti-influenza_CDR
ggcgggagcaucuccaac

SEQ ID NO: 14240 - RNA, 18 nt, Artificial Sequence
  derived and/or modified sequence opt1 from anti-influenza_CDR
ggcgggagcaucuccgcc

SEQ ID NO: 14241 - RNA, 18 nt, Artificial Sequence
  derived and/or modified sequence opt1 from anti-influenza_CDR
ggcuucagcguguccgac

SEQ ID NO: 14242 - RNA, 18 nt, Artificial Sequence
  derived and/or modified sequence opt1 from anti-influenza_CDR
agccgcucccuggacgug

SEQ ID NO: 14243 - RNA, 18 nt, Artificial Sequence
  derived and/or modified sequence opt1 from anti-influenza_CDR
cgcagccagcagaccgug

SEQ ID NO: 14244 - RNA, 18 nt, Artificial Sequence
  derived and/or modified sequence opt1 from anti-influenza_CDR
cagaccaucaacaacuac

SEQ ID NO: 14245 - RNA, 18 nt, Artificial Sequence
  derived and/or modified sequence opt1 from anti-influenza_CDR
aacaugggccccaccagc

SEQ ID NO: 14246 - RNA, 18 nt, Artificial Sequence
  derived and/or modified sequence opt1 from anti-influenza_CDR
cagguggucggcaccaac

SEQ ID NO: 14247 - RNA, 18 nt, Artificial Sequence
  derived and/or modified sequence opt1 from anti-influenza_CDR
cagggcaucaacacccac

SEQ ID NO: 14248 - RNA, 18 nt, Artificial Sequence
  derived and/or modified sequence opt1 from anti-influenza_CDR
caggacauccgcaaccgg

SEQ ID NO: 14249 - RNA, 18 nt, Artificial Sequence
  derived and/or modified sequence opt1 from anti-influenza_CDR
cagggcaucgggagcaac

SEQ ID NO: 14250 - RNA, 18 nt, Artificial Sequence
  derived and/or modified sequence opt1 from anti-influenza_CDR
cagaccaucuaccgcugg

SEQ ID NO: 14251 - RNA, 18 nt, Artificial Sequence
  derived and/or modified sequence opt1 from anti-influenza_CDR
cagaccaucacccgcuuc

SEQ ID NO: 14252 - RNA, 18 nt, Artificial Sequence
  derived and/or modified sequence opt1 from anti-influenza_CDR
cgccugggcgagaaguuc

SEQ ID NO: 14253 - RNA, 18 nt, Artificial Sequence
  derived and/or modified sequence opt1 from anti-influenza_CDR
aagcugggcgacaaguuc

SEQ ID NO: 14254 - RNA, 18 nt, Artificial Sequence
  derived and/or modified sequence opt1 from anti-influenza_CDR
cagggccuggggagcaac

SEQ ID NO: 14255 - RNA, 18 nt, Artificial Sequence
  derived and/or modified sequence opt1 from anti-influenza_CDR
uacaucggcagcaagucc

SEQ ID NO: 14256 - RNA, 18 nt, Artificial Sequence
  derived and/or modified sequence opt1 from anti-influenza_CDR
cagcugaucagcuccuac

SEQ ID NO: 14257 - RNA, 18 nt, Artificial Sequence
  derived and/or modified sequence opt1 from anti-influenza_CDR
cagagcguguccagcaac

SEQ ID NO: 14258 - RNA, 18 nt, Artificial Sequence
  derived and/or modified sequence opt1 from anti-influenza_CDR
caggugaucagcuccuac

SEQ ID NO: 14259 - RNA, 18 nt, Artificial Sequence
  derived and/or modified sequence opt1 from anti-influenza_CDR
cagagcgugaaccgcaac

SEQ ID NO: 14260 - RNA, 18 nt, Artificial Sequence
  derived and/or modified sequence opt1 from anti-influenza_CDR
gacaucggcagcaagucc

SEQ ID NO: 14261 - RNA, 18 nt, Artificial Sequence
  derived and/or modified sequence opt1 from anti-influenza_CDR
cagagcguguccaccaac

SEQ ID NO: 14262 - RNA, 18 nt, Artificial Sequence
  derived and/or modified sequence opt1 from anti-influenza_CDR
augaucgccggcuggcac

SEQ ID NO: 14263 - RNA, 18 nt, Artificial Sequence
  derived and/or modified sequence opt1 from anti-influenza_CDR
caggacaucagcaccugg

SEQ ID NO: 14264 - RNA, 18 nt, Artificial Sequence
  derived and/or modified sequence opt1 from anti-influenza_CDR
gagaagaucuacagcaac

SEQ ID NO: 14265 - RNA, 21 nt, Artificial Sequence
  derived and/or modified sequence opt1 from anti-influenza_CDR
aucuacuacaacuacaacauc

SEQ ID NO: 14266 - RNA, 21 nt, Artificial Sequence
  derived and/or modified sequence opt1 from anti-influenza_CDR
cagagcaucuccagcggcuac

SEQ ID NO: 14267 - RNA, 21 nt, Artificial Sequence
  derived and/or modified sequence opt1 from anti-influenza_CDR
cagagcguguccagcuccuac

SEQ ID NO: 14268 - RNA, 21 nt, Artificial Sequence
  derived and/or modified sequence opt1 from anti-influenza_CDR
cagaccgugagcuccagcuac

SEQ ID NO: 14269 - RNA, 21 nt, Artificial Sequence
  derived and/or modified sequence opt1 from anti-influenza_CDR
agcaacaacgccguguggaac

SEQ ID NO: 14270 - RNA, 21 nt, Artificial Sequence
  derived and/or modified sequence opt1 from anti-influenza_CDR
agcaacuccgccguguggaac

SEQ ID NO: 14271 - RNA, 21 nt, Artificial Sequence
  derived and/or modified sequence opt1 from anti-influenza_CDR
gccgccaccacccugcagagc

SEQ ID NO: 14272 - RNA, 21 nt, Artificial Sequence
  derived and/or modified sequence opt1 from anti-influenza_CDR
agcaaccgcgccaccuggaac

SEQ ID NO: 14273 - RNA, 21 nt, Artificial Sequence
  derived and/or modified sequence opt1 from anti-influenza_CDR
gccaccagcacccugcagucc

SEQ ID NO: 14274 - RNA, 21 nt, Artificial Sequence
  derived and/or modified sequence opt1 from anti-influenza_CDR
agcaacuccgccaccuggaac

SEQ ID NO: 14275 - RNA, 21 nt, Artificial Sequence
  derived and/or modified sequence opt1 from anti-influenza_CDR
gccagcuccacccugcagagc

SEQ ID NO: 14276 - RNA, 21 nt, Artificial Sequence
  derived and/or modified sequence opt1 from anti-influenza_CDR
agcuacaacgccguguggaac

SEQ ID NO: 14277 - RNA, 21 nt, Artificial Sequence
  derived and/or modified sequence opt1 from anti-influenza_CDR
gccgccagcucccgccugagc

SEQ ID NO: 14278 - RNA, 21 nt, Artificial Sequence
  derived and/or modified sequence opt1 from anti-influenza_CDR
gccgccagcucccgcggcagc

SEQ ID NO: 14279 - RNA, 21 nt, Artificial Sequence
  derived and/or modified sequence opt1 from anti-influenza_CDR
aucuaccacagcggcuccgcc

SEQ ID NO: 14280 - RNA, 21 nt, Artificial Sequence
  derived and/or modified sequence opt1 from anti-influenza_CDR
aucuacuacagcggcgugacc

SEQ ID NO: 14281 - RNA, 21 nt, Artificial Sequence
  derived and/or modified sequence opt1 from anti-influenza_CDR
agcuccuaccuggccugguac

SEQ ID NO: 14282 - RNA, 21 nt, Artificial Sequence
  derived and/or modified sequence opt1 from anti-influenza_CDR
cagagccuguccagcuccagc

SEQ ID NO: 14283 - RNA, 21 nt, Artificial Sequence
  derived and/or modified sequence opt1 from anti-influenza_CDR
cagagcguguccaucagcuac

SEQ ID NO: 14284 - RNA, 21 nt, Artificial Sequence
  derived and/or modified sequence opt1 from anti-influenza_CDR
gacgugaccgagcgccccagc

SEQ ID NO: 14285 - RNA, 21 nt, Artificial Sequence
  derived and/or modified sequence opt1 from anti-influenza_CDR
gccgccagcacccugcucgac

SEQ ID NO: 14286 - RNA, 21 nt, Artificial Sequence
  derived and/or modified sequence opt1 from anti-influenza_CDR
gccgccagcacccugcacucc

SEQ ID NO: 14287 - RNA, 21 nt, Artificial Sequence
  derived and/or modified sequence opt1 from anti-influenza_CDR
ggcgccagcucccugcagggg

SEQ ID NO: 14288 - RNA, 21 nt, Artificial Sequence
  derived and/or modified sequence opt1 from anti-influenza_CDR
accaacggcgugaacgucggg

SEQ ID NO: 14289 - RNA, 21 nt, Artificial Sequence
  derived and/or modified sequence opt1 from anti-influenza_CDR
gacgccagcacccgcgccacc

SEQ ID NO: 14290 - RNA, 21 nt, Artificial Sequence
  derived and/or modified sequence opt1 from anti-influenza_CDR
agcgagaccuacuacuggucc

SEQ ID NO: 14291 - RNA, 21 nt, Artificial Sequence
  derived and/or modified sequence opt1 from anti-influenza_CDR
gaggccgugaaccuggagagc

SEQ ID NO: 14292 - RNA, 21 nt, Artificial Sequence
  derived and/or modified sequence opt1 from anti-influenza_CDR
ggcgccagcacccgcgccacc

SEQ ID NO: 14293 - RNA, 21 nt, Artificial Sequence
  derived and/or modified sequence opt1 from anti-influenza_CDR
gugagcggcuacuacuggucc

SEQ ID NO: 14294 - RNA, 21 nt, Artificial Sequence
  derived and/or modified sequence opt1 from anti-influenza_CDR
aucaccggcgugcgcgucggg

SEQ ID NO: 14295 - RNA, 21 nt, Artificial Sequence
  derived and/or modified sequence opt1 from anti-influenza_CDR
gacgccagcaaccgcgccacc

SEQ ID NO: 14296 - RNA, 21 nt, Artificial Sequence
  derived and/or modified sequence opt1 from anti-influenza_CDR
gaggugaccaacuggcccagc

SEQ ID NO: 14297 - RNA, 21 nt, Artificial Sequence
  derived and/or modified sequence opt1 from anti-influenza_CDR
aaggacagcgagcgccccucc

SEQ ID NO: 14298 - RNA, 21 nt, Artificial Sequence
  derived and/or modified sequence opt1 from anti-influenza_CDR
agcggcaacuacuacuggaac

SEQ ID NO: 14299 - RNA, 21 nt, Artificial Sequence
  derived and/or modified sequence opt1 from anti-influenza_CDR
agcaccaccauccgccacucc

SEQ ID NO: 14300 - RNA, 21 nt, Artificial Sequence
  derived and/or modified sequence opt1 from anti-influenza_CDR
gacgacagcggccgccccucc

SEQ ID NO: 14301 - RNA, 21 nt, Artificial Sequence
  derived and/or modified sequence opt1 from anti-influenza_CDR
cgcaacgaccugcggcccagc

SEQ ID NO: 14302 - RNA, 21 nt, Artificial Sequence
  derived and/or modified sequence opt1 from anti-influenza_CDR
agcguggaccacuacuggucc

SEQ ID NO: 14303 - RNA, 21 nt, Artificial Sequence
  derived and/or modified sequence opt1 from anti-influenza_CDR
gccgugagcauccugcagucc

SEQ ID NO: 14304 - RNA, 21 nt, Artificial Sequence
  derived and/or modified sequence opt1 from anti-influenza_CDR
gacgacaccgaccgccccagc

SEQ ID NO: 14305 - RNA, 21 nt, Artificial Sequence
  derived and/or modified sequence opt1 from anti-influenza_CDR
gagaacaacaagcgccccagc

SEQ ID NO: 14306 - RNA, 21 nt, Artificial Sequence
  derived and/or modified sequence opt1 from anti-influenza_CDR
gacagcuccaaccgcgccccc

SEQ ID NO: 14307 - RNA, 21 nt, Artificial Sequence
  derived and/or modified sequence opt1 from anti-influenza_CDR
gaggugaccaagcgccccagc

SEQ ID NO: 14308 - RNA, 21 nt, Artificial Sequence
  derived and/or modified sequence opt1 from anti-influenza_CDR
gccaccagcaacacccacucc

SEQ ID NO: 14309 - RNA, 21 nt, Artificial Sequence
  derived and/or modified sequence opt1 from anti-influenza_CDR
gccgccagcaaccuggagaac

SEQ ID NO: 14310 - RNA, 21 nt, Artificial Sequence
  derived and/or modified sequence opt1 from anti-influenza_CDR
gccgccagcggccugcagucc

SEQ ID NO: 14311 - RNA, 21 nt, Artificial Sequence
  derived and/or modified sequence opt1 from anti-influenza_CDR
ggcuucaccgugagcuccaac

SEQ ID NO: 14312 - RNA, 21 nt, Artificial Sequence
  derived and/or modified sequence opt1 from anti-influenza_CDR
ggcgggggcuacagcuggaac

SEQ ID NO: 14313 - RNA, 21 nt, Artificial Sequence
  derived and/or modified sequence opt1 from anti-influenza_CDR
ggcgccagcaaccugcagucc

SEQ ID NO: 14314 - RNA, 21 nt, Artificial Sequence
  derived and/or modified sequence opt1 from anti-influenza_CDR
ggcgccaccaaccugcagagc

SEQ ID NO: 14315 - RNA, 21 nt, Artificial Sequence
  derived and/or modified sequence opt1 from anti-influenza_CDR
ggcgccagcaaccugcacucc

SEQ ID NO: 14316 - RNA, 21 nt, Artificial Sequence
  derived and/or modified sequence opt1 from anti-influenza_CDR
ggcgccagcacccugcagucc

SEQ ID NO: 14317 - RNA, 21 nt, Artificial Sequence
  derived and/or modified sequence opt1 from anti-influenza_CDR
gacaacagcgaccgccccucc

SEQ ID NO: 14318 - RNA, 21 nt, Artificial Sequence
  derived and/or modified sequence opt1 from anti-influenza_CDR
ggcgccagcucccugcagagc

SEQ ID NO: 14319 - RNA, 21 nt, Artificial Sequence
  derived and/or modified sequence opt1 from anti-influenza_CDR
ggcaacagcaaccgccccucc

SEQ ID NO: 14320 - RNA, 21 nt, Artificial Sequence
  derived and/or modified sequence opt1 from anti-influenza_CDR
gccgccagcucccugcagagc

SEQ ID NO: 14321 - RNA, 21 nt, Artificial Sequence
  derived and/or modified sequence opt1 from anti-influenza_CDR
gccgccagcucccugcacagc

SEQ ID NO: 14322 - RNA, 21 nt, Artificial Sequence
  derived and/or modified sequence opt1 from anti-influenza_CDR
ggcgccagcacccugcagaac

SEQ ID NO: 14323 - RNA, 21 nt, Artificial Sequence
  derived and/or modified sequence opt1 from anti-influenza_CDR
ggcgccaccgaccugcagagc

SEQ ID NO: 14324 - RNA, 21 nt, Artificial Sequence
  derived and/or modified sequence opt1 from anti-influenza_CDR
agcggcgccuacuacuggacc

SEQ ID NO: 14325 - RNA, 21 nt, Artificial Sequence
  derived and/or modified sequence opt1 from anti-influenza_CDR
gugagcgacaacuacaucaac

SEQ ID NO: 14326 - RNA, 21 nt, Artificial Sequence
  derived and/or modified sequence opt1 from anti-influenza_CDR
ugggccagcacccgcgagucc

SEQ ID NO: 14327 - RNA, 21 nt, Artificial Sequence
  derived and/or modified sequence opt1 from anti-influenza_CDR
agcaacaaccagcgccccucc

SEQ ID NO: 14328 - RNA, 21 nt, Artificial Sequence
  derived and/or modified sequence opt1 from anti-influenza_CDR
gaggugagcaaccgccccucc

SEQ ID NO: 14329 - RNA, 21 nt, Artificial Sequence
  derived and/or modified sequence opt1 from anti-influenza_CDR
aagaacacccagcgccccagc

SEQ ID NO: 14330 - RNA, 21 nt, Artificial Sequence
  derived and/or modified sequence opt1 from anti-influenza_CDR
gacaacaacaagcgccccagc

SEQ ID NO: 14331 - RNA, 21 nt, Artificial Sequence
  derived and/or modified sequence opt1 from anti-influenza_CDR
gacgccagcacccugcgcucc

SEQ ID NO: 14332 - RNA, 21 nt, Artificial Sequence
  derived and/or modified sequence opt1 from anti-influenza_CDR
caggacaaccgccggcccagc

SEQ ID NO: 14333 - RNA, 21 nt, Artificial Sequence
  derived and/or modified sequence opt1 from anti-influenza_CDR
gacgugagcaagcgccccucc

SEQ ID NO: 14334 - RNA, 21 nt, Artificial Sequence
  derived and/or modified sequence opt1 from anti-influenza_CDR
gacgccagcucccgcgccacc

SEQ ID NO: 14335 - RNA, 21 nt, Artificial Sequence
  derived and/or modified sequence opt1 from anti-influenza_CDR
cugggcagcaaccgcgccucc

SEQ ID NO: 14336 - RNA, 21 nt, Artificial Sequence
  derived and/or modified sequence opt1 from anti-influenza_CDR
ggcgccagcacccgcgccgcg

SEQ ID NO: 14337 - RNA, 21 nt, Artificial Sequence
  derived and/or modified sequence opt1 from anti-influenza_CDR
gacgacagcgaccgccccucc

SEQ ID NO: 14338 - RNA, 21 nt, Artificial Sequence
  derived and/or modified sequence opt1 from anti-influenza_CDR
cgcgacggccagcggcccagc

SEQ ID NO: 14339 - RNA, 21 nt, Artificial Sequence
  derived and/or modified sequence opt1 from anti-influenza_CDR
ggcgccagcucccgcgccacc

SEQ ID NO: 14340 - RNA, 21 nt, Artificial Sequence
  derived and/or modified sequence opt1 from anti-influenza_CDR
ggcgccagcucccgcgccagc

SEQ ID NO: 14341 - RNA, 21 nt, Artificial Sequence
  derived and/or modified sequence opt1 from anti-influenza_CDR
gccgccagcacccugcagucc

SEQ ID NO: 14342 - RNA, 21 nt, Artificial Sequence
  derived and/or modified sequence opt1 from anti-influenza_CDR
cuggugagcaagcgcgccucc

SEQ ID NO: 14343 - RNA, 21 nt, Artificial Sequence
  derived and/or modified sequence opt1 from anti-influenza_CDR
gacgugaccuaccgccccagc

SEQ ID NO: 14344 - RNA, 21 nt, Artificial Sequence
  derived and/or modified sequence opt1 from anti-influenza_CDR
augcaggcccuggagaccccc

SEQ ID NO: 14345 - RNA, 21 nt, Artificial Sequence
  derived and/or modified sequence opt1 from anti-influenza_CDR
cagaacuacggcagccccuuc

SEQ ID NO: 14346 - RNA, 21 nt, Artificial Sequence
  derived and/or modified sequence opt1 from anti-influenza_CDR
cagcaguacggcagccugccc

SEQ ID NO: 14347 - RNA, 21 nt, Artificial Sequence
  derived and/or modified sequence opt1 from anti-influenza_CDR
uggggcagcuaccuggagucc

SEQ ID NO: 14348 - RNA, 21 nt, Artificial Sequence
  derived and/or modified sequence opt1 from anti-influenza_CDR
agcgccuccacccgcgccacc

SEQ ID NO: 14349 - RNA, 21 nt, Artificial Sequence
  derived and/or modified sequence opt1 from anti-influenza_CDR
ggcgccagcacccgcgccucc

SEQ ID NO: 14350 - RNA, 21 nt, Artificial Sequence
  derived and/or modified sequence opt1 from anti-influenza_CDR
ggcgccagcacccgcgacacc

SEQ ID NO: 14351 - RNA, 21 nt, Artificial Sequence
  derived and/or modified sequence opt1 from anti-influenza_CDR
aaggugagcacccuggagucc

SEQ ID NO: 14352 - RNA, 21 nt, Artificial Sequence
  derived and/or modified sequence opt1 from anti-influenza_CDR
agcaacaccgagcgccccucc

SEQ ID NO: 14353 - RNA, 21 nt, Artificial Sequence
  derived and/or modified sequence opt1 from anti-influenza_CDR
aagaucagcaaccgcgacucc

SEQ ID NO: 14354 - RNA, 21 nt, Artificial Sequence
  derived and/or modified sequence opt1 from anti-influenza_CDR
agcgccucccaccgcuacagc

SEQ ID NO: 14355 - RNA, 21 nt, Artificial Sequence
  derived and/or modified sequence opt1 from anti-influenza_CDR
cagagcgugcgcuccaacaac

SEQ ID NO: 14356 - RNA, 21 nt, Artificial Sequence
  derived and/or modified sequence opt1 from anti-influenza_CDR
cagagcgugcgcuccggcuac

SEQ ID NO: 14357 - RNA, 21 nt, Artificial Sequence
  derived and/or modified sequence opt1 from anti-influenza_CDR
aucuacuaccgcggcagcacc

SEQ ID NO: 14358 - RNA, 21 nt, Artificial Sequence
  derived and/or modified sequence opt1 from anti-influenza_CDR
guguacuacagcggcaucacc

SEQ ID NO: 14359 - RNA, 21 nt, Artificial Sequence
  derived and/or modified sequence opt1 from anti-influenza_CDR
agccacuucgccaaccugaag

SEQ ID NO: 14360 - RNA, 21 nt, Artificial Sequence
  derived and/or modified sequence opt1 from anti-influenza_CDR
cugaacaagagcaagcccuac

SEQ ID NO: 14361 - RNA, 21 nt, Artificial Sequence
  derived and/or modified sequence opt1 from anti-influenza_CDR
aagcuggccaacaccggcacc

SEQ ID NO: 14362 - RNA, 21 nt, Artificial Sequence
  derived and/or modified sequence opt1 from anti-influenza_CDR
gccgccagcacccugaccucc

SEQ ID NO: 14363 - RNA, 21 nt, Artificial Sequence
  derived and/or modified sequence opt1 from anti-influenza_CDR
gacgccagcaagcuggccucc

SEQ ID NO: 14364 - RNA, 21 nt, Artificial Sequence
  derived and/or modified sequence opt1 from anti-influenza_CDR
uucgccagccgccuggccucc

SEQ ID NO: 14365 - RNA, 21 nt, Artificial Sequence
  derived and/or modified sequence opt1 from anti-influenza_CDR
agcgccuccacccuggccagc

SEQ ID NO: 14366 - RNA, 21 nt, Artificial Sequence
  derived and/or modified sequence opt1 from anti-influenza_CDR
gaggugagccagcgccccucc

SEQ ID NO: 14367 - RNA, 21 nt, Artificial Sequence
  derived and/or modified sequence opt1 from anti-influenza_CDR
ggcgggacccugaacaacuac

SEQ ID NO: 14368 - RNA, 21 nt, Artificial Sequence
  derived and/or modified sequence opt1 from anti-influenza_CDR
gacaucgugaugacccagagc

SEQ ID NO: 14369 - RNA, 24 nt, Artificial Sequence
  derived and/or modified sequence opt1 from anti-influenza_CDR
ggcuucaccuucagcaacuacgcc

SEQ ID NO: 14370 - RNA, 24 nt, Artificial Sequence
  derived and/or modified sequence opt1 from anti-influenza_CDR
ggcuucaccuucagcaacuacggg

SEQ ID NO: 14371 - RNA, 24 nt, Artificial Sequence
  derived and/or modified sequence opt1 from anti-influenza_CDR
ggcuucaccuucagcuccuacgcc

SEQ ID NO: 14372 - RNA, 24 nt, Artificial Sequence
  derived and/or modified sequence opt1 from anti-influenza_CDR
ggcuucaccuucagcaccuacgcc

SEQ ID NO: 14373 - RNA, 24 nt, Artificial Sequence
  derived and/or modified sequence opt1 from anti-influenza_CDR
ggcgggaucuucaucagccaggcc

SEQ ID NO: 14374 - RNA, 24 nt, Artificial Sequence
  derived and/or modified sequence opt1 from anti-influenza_CDR
ggcgggaucuucagccccuacgcc

SEQ ID NO: 14375 - RNA, 24 nt, Artificial Sequence
  derived and/or modified sequence opt1 from anti-influenza_CDR
ggcgggcccuucagcggcuucgcc

SEQ ID NO: 14376 - RNA, 24 nt, Artificial Sequence
  derived and/or modified sequence opt1 from anti-influenza_CDR
ggcgggaccuucaacagccacgcc

SEQ ID NO: 14377 - RNA, 24 nt, Artificial Sequence
  derived and/or modified sequence opt1 from anti-influenza_CDR
ggcagcaacaucggguccaacacc

SEQ ID NO: 14378 - RNA, 24 nt, Artificial Sequence
  derived and/or modified sequence opt1 from anti-influenza_CDR
ggcgugaccuucagcauguacgcc

SEQ ID NO: 14379 - RNA, 24 nt, Artificial Sequence
  derived and/or modified sequence opt1 from anti-influenza_CDR
ggcgugaccuucagcauguacacc

SEQ ID NO: 14380 - RNA, 24 nt, Artificial Sequence
  derived and/or modified sequence opt1 from anti-influenza_CDR
ggcgugaccagcuccaacuacccc

SEQ ID NO: 14381 - RNA, 24 nt, Artificial Sequence
  derived and/or modified sequence opt1 from anti-influenza_CDR
aucaucgccaucuucggcaccacc

SEQ ID NO: 14382 - RNA, 24 nt, Artificial Sequence
  derived and/or modified sequence opt1 from anti-influenza_CDR
aucaucccccuguucggcaccgcc

SEQ ID NO: 14383 - RNA, 24 nt, Artificial Sequence
  derived and/or modified sequence opt1 from anti-influenza_CDR
aucaucccccuguucggcaccacc

SEQ ID NO: 14384 - RNA, 24 nt, Artificial Sequence
  derived and/or modified sequence opt1 from anti-influenza_CDR
aucauccccauguucggcgccacc

SEQ ID NO: 14385 - RNA, 24 nt, Artificial Sequence
  derived and/or modified sequence opt1 from anti-influenza_CDR
aucauccccauguucggcaccacc

SEQ ID NO: 14386 - RNA, 24 nt, Artificial Sequence
  derived and/or modified sequence opt1 from anti-influenza_CDR
aucaacagcggcgggggcgccacc

SEQ ID NO: 14387 - RNA, 24 nt, Artificial Sequence
  derived and/or modified sequence opt1 from anti-influenza_CDR
aucagcgccguguucggcaccgcc

SEQ ID NO: 14388 - RNA, 24 nt, Artificial Sequence
  derived and/or modified sequence opt1 from anti-influenza_CDR
aucagcuacgacgccaacuacaag

SEQ ID NO: 14389 - RNA, 24 nt, Artificial Sequence
  derived and/or modified sequence opt1 from anti-influenza_CDR
aucagcuacgacggcaacuacaag

SEQ ID NO: 14390 - RNA, 24 nt, Artificial Sequence
  derived and/or modified sequence opt1 from anti-influenza_CDR
aucagcuacgacggcuccaacaag

SEQ ID NO: 14391 - RNA, 24 nt, Artificial Sequence
  derived and/or modified sequence opt1 from anti-influenza_CDR
aucagcuacgacggcuccaaccag

SEQ ID NO: 14392 - RNA, 24 nt, Artificial Sequence
  derived and/or modified sequence opt1 from anti-influenza_CDR
cagcaguacuaccgcagccccucc

SEQ ID NO: 14393 - RNA, 24 nt, Artificial Sequence
  derived and/or modified sequence opt1 from anti-influenza_CDR
gugcugccccucuucggcgucacc

SEQ ID NO: 14394 - RNA, 24 nt, Artificial Sequence
  derived and/or modified sequence opt1 from anti-influenza_CDR
ggcgggaccuucagcuccgacgcc

SEQ ID NO: 14395 - RNA, 24 nt, Artificial Sequence
  derived and/or modified sequence opt1 from anti-influenza_CDR
aucauccccguguuccagaccgcc

SEQ ID NO: 14396 - RNA, 24 nt, Artificial Sequence
  derived and/or modified sequence opt1 from anti-influenza_CDR
accagcaacaucggcuccaacgcc

SEQ ID NO: 14397 - RNA, 24 nt, Artificial Sequence
  derived and/or modified sequence opt1 from anti-influenza_CDR
ggcuacagcuucaccucccgcugg

SEQ ID NO: 14398 - RNA, 24 nt, Artificial Sequence
  derived and/or modified sequence opt1 from anti-influenza_CDR
aucuaccccagcgacuccgacgug

SEQ ID NO: 14399 - RNA, 24 nt, Artificial Sequence
  derived and/or modified sequence opt1 from anti-influenza_CDR
cagcaguacgacaacuggcugagc

SEQ ID NO: 14400 - RNA, 24 nt, Artificial Sequence
  derived and/or modified sequence opt1 from anti-influenza_CDR
ggcgggaccuucagcaacuacggc

SEQ ID NO: 14401 - RNA, 24 nt, Artificial Sequence
  derived and/or modified sequence opt1 from anti-influenza_CDR
ggcgccagcaucuccagcuccuac

SEQ ID NO: 14402 - RNA, 24 nt, Artificial Sequence
  derived and/or modified sequence opt1 from anti-influenza_CDR
ggcgggaccuucagcuccuacgac

SEQ ID NO: 14403 - RNA, 24 nt, Artificial Sequence
  derived and/or modified sequence opt1 from anti-influenza_CDR
aucauccccaucuacggcaccgcc

SEQ ID NO: 14404 - RNA, 24 nt, Artificial Sequence
  derived and/or modified sequence opt1 from anti-influenza_CDR
ggcuacaccagcaccacguacggg

SEQ ID NO: 14405 - RNA, 24 nt, Artificial Sequence
  derived and/or modified sequence opt1 from anti-influenza_CDR
aucaaccccuacaacggcaacccg

SEQ ID NO: 14406 - RNA, 24 nt, Artificial Sequence
  derived and/or modified sequence opt1 from anti-influenza_CDR
aucugguacgacggcgacaacaag

SEQ ID NO: 14407 - RNA, 24 nt, Artificial Sequence
  derived and/or modified sequence opt1 from anti-influenza_CDR
ggcuucaccuucagcgacuucugg

SEQ ID NO: 14408 - RNA, 24 nt, Artificial Sequence
  derived and/or modified sequence opt1 from anti-influenza_CDR
aucgaccaggacggcaacgagcgc

SEQ ID NO: 14409 - RNA, 24 nt, Artificial Sequence
  derived and/or modified sequence opt1 from anti-influenza_CDR
agcuccaacaucggcaagaacuac

SEQ ID NO: 14410 - RNA, 24 nt, Artificial Sequence
  derived and/or modified sequence opt1 from anti-influenza_CDR
ggcuacaccuucaccaacuacugg

SEQ ID NO: 14411 - RNA, 24 nt, Artificial Sequence
  derived and/or modified sequence opt1 from anti-influenza_CDR
aucuucccgcccgacagccagacc

SEQ ID NO: 14412 - RNA, 24 nt, Artificial Sequence
  derived and/or modified sequence opt1 from anti-influenza_CDR
ggcuacagcuucuccgacuacugg

SEQ ID NO: 14413 - RNA, 24 nt, Artificial Sequence
  derived and/or modified sequence opt1 from anti-influenza_CDR
aucuaccccgccagcuccgagauc

SEQ ID NO: 14414 - RNA, 24 nt, Artificial Sequence
  derived and/or modified sequence opt1 from anti-influenza_CDR
agcggcgacuccgggaccuggaac

SEQ ID NO: 14415 - RNA, 24 nt, Artificial Sequence
  derived and/or modified sequence opt1 from anti-influenza_CDR
ggcgggacccugaacaacuacgcc

SEQ ID NO: 14416 - RNA, 24 nt, Artificial Sequence
  derived and/or modified sequence opt1 from anti-influenza_CDR
aucagccccaucuucggcacccug

SEQ ID NO: 14417 - RNA, 24 nt, Artificial Sequence
  derived and/or modified sequence opt1 from anti-influenza_CDR
ggcguguucuucagcucccacgcc

SEQ ID NO: 14418 - RNA, 24 nt, Artificial Sequence
  derived and/or modified sequence opt1 from anti-influenza_CDR
aucagccccauguucggcaccacc

SEQ ID NO: 14419 - RNA, 24 nt, Artificial Sequence
  derived and/or modified sequence opt1 from anti-influenza_CDR
ggcuucaccuucagccgcuucggg

SEQ ID NO: 14420 - RNA, 24 nt, Artificial Sequence
  derived and/or modified sequence opt1 from anti-influenza_CDR
aucugguacgacggcagcaacaag

SEQ ID NO: 14421 - RNA, 24 nt, Artificial Sequence
  derived and/or modified sequence opt1 from anti-influenza_CDR
cagaccuacggcggggugagcacc

SEQ ID NO: 14422 - RNA, 24 nt, Artificial Sequence
  derived and/or modified sequence opt1 from anti-influenza_CDR
gacagcgccggcaaccgccacucc

SEQ ID NO: 14423 - RNA, 24 nt, Artificial Sequence
  derived and/or modified sequence opt1 from anti-influenza_CDR
uuccgcggcgggaacagccugucc

SEQ ID NO: 14424 - RNA, 24 nt, Artificial Sequence
  derived and/or modified sequence opt1 from anti-influenza_CDR
ggcuacaccuucaccacguacugg

SEQ ID NO: 14425 - RNA, 24 nt, Artificial Sequence
  derived and/or modified sequence opt1 from anti-influenza_CDR
aucgaccccuacgacagcgagacc

SEQ ID NO: 14426 - RNA, 24 nt, Artificial Sequence
  derived and/or modified sequence opt1 from anti-influenza_CDR
auccgcaaguuccugaacugguac

SEQ ID NO: 14427 - RNA, 24 nt, Artificial Sequence
  derived and/or modified sequence opt1 from anti-influenza_CDR
cagcaguacgacggccugcccuuc

SEQ ID NO: 14428 - RNA, 24 nt, Artificial Sequence
  derived and/or modified sequence opt1 from anti-influenza_CDR
auccgcaacagccugaacugguac

SEQ ID NO: 14429 - RNA, 24 nt, Artificial Sequence
  derived and/or modified sequence opt1 from anti-influenza_CDR
cagcaggccaacagcuucccccug

SEQ ID NO: 14430 - RNA, 24 nt, Artificial Sequence
  derived and/or modified sequence opt1 from anti-influenza_CDR
agccugcucaccgagguggagacc

SEQ ID NO: 14431 - RNA, 24 nt, Artificial Sequence
  derived and/or modified sequence opt1 from anti-influenza_CDR
cagcagagcuacuccaugcccgcc

SEQ ID NO: 14432 - RNA, 24 nt, Artificial Sequence
  derived and/or modified sequence opt1 from anti-influenza_CDR
ggcgggcccgugagcggcgggggc

SEQ ID NO: 14433 - RNA, 24 nt, Artificial Sequence
  derived and/or modified sequence opt1 from anti-influenza_CDR
cagcagagcuucuccgugcccgcc

SEQ ID NO: 14434 - RNA, 24 nt, Artificial Sequence
  derived and/or modified sequence opt1 from anti-influenza_CDR
cagcagaccuacagcaucccccug

SEQ ID NO: 14435 - RNA, 24 nt, Artificial Sequence
  derived and/or modified sequence opt1 from anti-influenza_CDR
cagcagagcuacuccgugcccgcc

SEQ ID NO: 14436 - RNA, 24 nt, Artificial Sequence
  derived and/or modified sequence opt1 from anti-influenza_CDR
cagcagaccuucagcaucccccug

SEQ ID NO: 14437 - RNA, 24 nt, Artificial Sequence
  derived and/or modified sequence opt1 from anti-influenza_CDR
ggcgacagcaucaccuccggggcc

SEQ ID NO: 14438 - RNA, 24 nt, Artificial Sequence
  derived and/or modified sequence opt1 from anti-influenza_CDR
caggccugggacagcuccaccgcc

SEQ ID NO: 14439 - RNA, 24 nt, Artificial Sequence
  derived and/or modified sequence opt1 from anti-influenza_CDR
cagcaguacggcagcucccugugg

SEQ ID NO: 14440 - RNA, 24 nt, Artificial Sequence
  derived and/or modified sequence opt1 from anti-influenza_CDR
gccuacggcuacaccuucgacccc

SEQ ID NO: 14441 - RNA, 24 nt, Artificial Sequence
  derived and/or modified sequence opt1 from anti-influenza_CDR
augcaggcccugcagaccccccuc

SEQ ID NO: 14442 - RNA, 24 nt, Artificial Sequence
  derived and/or modified sequence opt1 from anti-influenza_CDR
cagcaguacggcagcucccugacc

SEQ ID NO: 14443 - RNA, 24 nt, Artificial Sequence
  derived and/or modified sequence opt1 from anti-influenza_CDR
cagaaguacaacagcgcccccucc

SEQ ID NO: 14444 - RNA, 24 nt, Artificial Sequence
  derived and/or modified sequence opt1 from anti-influenza_CDR
cagcagcgcagcaacuggcugaag

SEQ ID NO: 14445 - RNA, 24 nt, Artificial Sequence
  derived and/or modified sequence opt1 from anti-influenza_CDR
agcucccagagccgcuccagcacc

SEQ ID NO: 14446 - RNA, 24 nt, Artificial Sequence
  derived and/or modified sequence opt1 from anti-influenza_CDR
cccuacgacgugccggacuacgag

SEQ ID NO: 14447 - RNA, 24 nt, Artificial Sequence
  derived and/or modified sequence opt1 from anti-influenza_CDR
cccuacgacgugccggacuacgcc

SEQ ID NO: 14448 - RNA, 24 nt, Artificial Sequence
  derived and/or modified sequence opt1 from anti-influenza_CDR
cccggcgacuucaacgacuacgag

SEQ ID NO: 14449 - RNA, 24 nt, Artificial Sequence
  derived and/or modified sequence opt1 from anti-influenza_CDR
cccaaggugcgcgaccaggagagc

SEQ ID NO: 14450 - RNA, 24 nt, Artificial Sequence
  derived and/or modified sequence opt1 from anti-influenza_CDR
accagcuacaccuccagcaacacg

SEQ ID NO: 14451 - RNA, 24 nt, Artificial Sequence
  derived and/or modified sequence opt1 from anti-influenza_CDR
ggcgggaacuucaacaacuacgcc

SEQ ID NO: 14452 - RNA, 24 nt, Artificial Sequence
  derived and/or modified sequence opt1 from anti-influenza_CDR
aucagccccaucuucggcuccacc

SEQ ID NO: 14453 - RNA, 24 nt, Artificial Sequence
  derived and/or modified sequence opt1 from anti-influenza_CDR
agcuccuacaccagcuccaacacc

SEQ ID NO: 14454 - RNA, 24 nt, Artificial Sequence
  derived and/or modified sequence opt1 from anti-influenza_CDR
ggcgggaccuucaacaacuacgcc

SEQ ID NO: 14455 - RNA, 24 nt, Artificial Sequence
  derived and/or modified sequence opt1 from anti-influenza_CDR
aucagccccaucuucggcuccgug

SEQ ID NO: 14456 - RNA, 24 nt, Artificial Sequence
  derived and/or modified sequence opt1 from anti-influenza_CDR
agcuccaacaucggccacaacuuc

SEQ ID NO: 14457 - RNA, 24 nt, Artificial Sequence
  derived and/or modified sequence opt1 from anti-influenza_CDR
ggcaccugggacagcucccugagc

SEQ ID NO: 14458 - RNA, 24 nt, Artificial Sequence
  derived and/or modified sequence opt1 from anti-influenza_CDR
ggcgggaucauccgcaaguacgcc

SEQ ID NO: 14459 - RNA, 24 nt, Artificial Sequence
  derived and/or modified sequence opt1 from anti-influenza_CDR
aucaucgccaucuucaacaccgcc

SEQ ID NO: 14460 - RNA, 24 nt, Artificial Sequence
  derived and/or modified sequence opt1 from anti-influenza_CDR
ggcuacaccuucaccgccuacacg

SEQ ID NO: 14461 - RNA, 24 nt, Artificial Sequence
  derived and/or modified sequence opt1 from anti-influenza_CDR
aucaacgccggcaacgggcacacc

SEQ ID NO: 14462 - RNA, 24 nt, Artificial Sequence
  derived and/or modified sequence opt1 from anti-influenza_CDR
ggcgggaccuucaucaacuacgcc

SEQ ID NO: 14463 - RNA, 24 nt, Artificial Sequence
  derived and/or modified sequence opt1 from anti-influenza_CDR
aucauccccguguacggcaccagc

SEQ ID NO: 14464 - RNA, 24 nt, Artificial Sequence
  derived and/or modified sequence opt1 from anti-influenza_CDR
ggcuucaccuuccgcagccacgcc

SEQ ID NO: 14465 - RNA, 24 nt, Artificial Sequence
  derived and/or modified sequence opt1 from anti-influenza_CDR
aucagcuacgacgaggugaacaag

SEQ ID NO: 14466 - RNA, 24 nt, Artificial Sequence
  derived and/or modified sequence opt1 from anti-influenza_CDR
ggcuacaacuucgccgccuacuac

SEQ ID NO: 14467 - RNA, 24 nt, Artificial Sequence
  derived and/or modified sequence opt1 from anti-influenza_CDR
agcaaccccaacaccggcggggcc

SEQ ID NO: 14468 - RNA, 24 nt, Artificial Sequence
  derived and/or modified sequence opt1 from anti-influenza_CDR
ggcuacacccugaucgacuacuac

SEQ ID NO: 14469 - RNA, 24 nt, Artificial Sequence
  derived and/or modified sequence opt1 from anti-influenza_CDR
aucaaccccaucaacggcgggacc

SEQ ID NO: 14470 - RNA, 24 nt, Artificial Sequence
  derived and/or modified sequence opt1 from anti-influenza_CDR
ggcuucaccuucagcgccuacgcc

SEQ ID NO: 14471 - RNA, 24 nt, Artificial Sequence
  derived and/or modified sequence opt1 from anti-influenza_CDR
accagcuacgacggccgcgacucc

SEQ ID NO: 14472 - RNA, 24 nt, Artificial Sequence
  derived and/or modified sequence opt1 from anti-influenza_CDR
ggcuucaccuucaccaacuacgcc

SEQ ID NO: 14473 - RNA, 24 nt, Artificial Sequence
  derived and/or modified sequence opt1 from anti-influenza_CDR
aucagcuucgacgaggacaacaag

SEQ ID NO: 14474 - RNA, 24 nt, Artificial Sequence
  derived and/or modified sequence opt1 from anti-influenza_CDR
ggcuucaacuucagcuccuacggg

SEQ ID NO: 14475 - RNA, 24 nt, Artificial Sequence
  derived and/or modified sequence opt1 from anti-influenza_CDR
aucuggagcggcggguccaacaag

SEQ ID NO: 14476 - RNA, 24 nt, Artificial Sequence
  derived and/or modified sequence opt1 from anti-influenza_CDR
ggcuucaucuucggggacuucgcc

SEQ ID NO: 14477 - RNA, 24 nt, Artificial Sequence
  derived and/or modified sequence opt1 from anti-influenza_CDR
ggcuucaacuucgacgaguacgug

SEQ ID NO: 14478 - RNA, 24 nt, Artificial Sequence
  derived and/or modified sequence opt1 from anti-influenza_CDR
aucggcgccgacgggcgcggcacc

SEQ ID NO: 14479 - RNA, 24 nt, Artificial Sequence
  derived and/or modified sequence opt1 from anti-influenza_CDR
ggcgggagcguguccaacuacuac

SEQ ID NO: 14480 - RNA, 24 nt, Artificial Sequence
  derived and/or modified sequence opt1 from anti-influenza_CDR
ggcgggaccuucagcuacuacgcc

SEQ ID NO: 14481 - RNA, 24 nt, Artificial Sequence
  derived and/or modified sequence opt1 from anti-influenza_CDR
aucauccccaucgugggcaccgcc

SEQ ID NO: 14482 - RNA, 24 nt, Artificial Sequence
  derived and/or modified sequence opt1 from anti-influenza_CDR
accagcaacaucggcuccaacacc

SEQ ID NO: 14483 - RNA, 24 nt, Artificial Sequence
  derived and/or modified sequence opt1 from anti-influenza_CDR
ggcuacaacuuccccaaguacugg

SEQ ID NO: 14484 - RNA, 24 nt, Artificial Sequence
  derived and/or modified sequence opt1 from anti-influenza_CDR
aucuaccccggcgacagcgacgug

SEQ ID NO: 14485 - RNA, 24 nt, Artificial Sequence
  derived and/or modified sequence opt1 from anti-influenza_CDR
ggccacaccuucaucagcuacgcc

SEQ ID NO: 14486 - RNA, 24 nt, Artificial Sequence
  derived and/or modified sequence opt1 from anti-influenza_CDR
aucgugcccaucuucggcaccguc

SEQ ID NO: 14487 - RNA, 24 nt, Artificial Sequence
  derived and/or modified sequence opt1 from anti-influenza_CDR
ggcuucaccuuccgcaccuacggg

SEQ ID NO: 14488 - RNA, 24 nt, Artificial Sequence
  derived and/or modified sequence opt1 from anti-influenza_CDR
aucagcuacgacggcaccaacaag

SEQ ID NO: 14489 - RNA, 24 nt, Artificial Sequence
  derived and/or modified sequence opt1 from anti-influenza_CDR
ggcuucaccuucagcuccuacggg

SEQ ID NO: 14490 - RNA, 24 nt, Artificial Sequence
  derived and/or modified sequence opt1 from anti-influenza_CDR
aucagcuacgacgagaucaacaag

SEQ ID NO: 14491 - RNA, 24 nt, Artificial Sequence
  derived and/or modified sequence opt1 from anti-influenza_CDR
ggcuucagccuguggaccuccggg

SEQ ID NO: 14492 - RNA, 24 nt, Artificial Sequence
  derived and/or modified sequence opt1 from anti-influenza_CDR
augagcuacgacgagaccaagaag

SEQ ID NO: 14493 - RNA, 24 nt, Artificial Sequence
  derived and/or modified sequence opt1 from anti-influenza_CDR
ggcuucaccuucagccgcuacucc

SEQ ID NO: 14494 - RNA, 24 nt, Artificial Sequence
  derived and/or modified sequence opt1 from anti-influenza_CDR
aucagcgacaccucccgcaccauc

SEQ ID NO: 14495 - RNA, 24 nt, Artificial Sequence
  derived and/or modified sequence opt1 from anti-influenza_CDR
ggcuucaccuucaacagcuacgcc

SEQ ID NO: 14496 - RNA, 24 nt, Artificial Sequence
  derived and/or modified sequence opt1 from anti-influenza_CDR
auccgcggcagcggggagaacacc

SEQ ID NO: 14497 - RNA, 24 nt, Artificial Sequence
  derived and/or modified sequence opt1 from anti-influenza_CDR
ggcuucaccuucagccgcuucucc

SEQ ID NO: 14498 - RNA, 24 nt, Artificial Sequence
  derived and/or modified sequence opt1 from anti-influenza_CDR
aucagcgacaccggccgcaccauc

SEQ ID NO: 14499 - RNA, 24 nt, Artificial Sequence
  derived and/or modified sequence opt1 from anti-influenza_CDR
ggcgacagcuucaccuccuacugg

SEQ ID NO: 14500 - RNA, 24 nt, Artificial Sequence
  derived and/or modified sequence opt1 from anti-influenza_CDR
aucuacccccgcgacagcgagacc

SEQ ID NO: 14501 - RNA, 24 nt, Artificial Sequence
  derived and/or modified sequence opt1 from anti-influenza_CDR
ggcuacaccuucaccgccuaccac

SEQ ID NO: 14502 - RNA, 24 nt, Artificial Sequence
  derived and/or modified sequence opt1 from anti-influenza_CDR
aucaaccccaacagcggcgccacc

SEQ ID NO: 14503 - RNA, 24 nt, Artificial Sequence
  derived and/or modified sequence opt1 from anti-influenza_CDR
ggcuucaccuucagcgacuacugg

SEQ ID NO: 14504 - RNA, 24 nt, Artificial Sequence
  derived and/or modified sequence opt1 from anti-influenza_CDR
aucagcuccgacggcagcaccacc

SEQ ID NO: 14505 - RNA, 24 nt, Artificial Sequence
  derived and/or modified sequence opt1 from anti-influenza_CDR
ggcuucagcuucuccaacgccugg

SEQ ID NO: 14506 - RNA, 24 nt, Artificial Sequence
  derived and/or modified sequence opt1 from anti-influenza_CDR
ggccugaccuucagcaacgccugg

SEQ ID NO: 14507 - RNA, 24 nt, Artificial Sequence
  derived and/or modified sequence opt1 from anti-influenza_CDR
ggcuucaccuucagcaacgccugg

SEQ ID NO: 14508 - RNA, 24 nt, Artificial Sequence
  derived and/or modified sequence opt1 from anti-influenza_CDR
ggccugagcuuccucaacgccugg

SEQ ID NO: 14509 - RNA, 24 nt, Artificial Sequence
  derived and/or modified sequence opt1 from anti-influenza_CDR
ggcuucagcuuccugaacgccugg

SEQ ID NO: 14510 - RNA, 24 nt, Artificial Sequence
  derived and/or modified sequence opt1 from anti-influenza_CDR
ggccugaccuuccucaacgccugg

SEQ ID NO: 14511 - RNA, 24 nt, Artificial Sequence
  derived and/or modified sequence opt1 from anti-influenza_CDR
ggcuucaccuuccugaacgccugg

SEQ ID NO: 14512 - RNA, 24 nt, Artificial Sequence
  derived and/or modified sequence opt1 from anti-influenza_CDR
ggcuacaccuucaccgacuacuac

SEQ ID NO: 14513 - RNA, 24 nt, Artificial Sequence
  derived and/or modified sequence opt1 from anti-influenza_CDR
gugaaccccuacagcggcgggacc

SEQ ID NO: 14514 - RNA, 24 nt, Artificial Sequence
  derived and/or modified sequence opt1 from anti-influenza_CDR
ggcuacaccuucaccgacuacaac

SEQ ID NO: 14515 - RNA, 24 nt, Artificial Sequence
  derived and/or modified sequence opt1 from anti-influenza_CDR
aucuaccccaacaacggcgggacc

SEQ ID NO: 14516 - RNA, 24 nt, Artificial Sequence
  derived and/or modified sequence opt1 from anti-influenza_CDR
ggcuacaccuucaccggguacaac

SEQ ID NO: 14517 - RNA, 24 nt, Artificial Sequence
  derived and/or modified sequence opt1 from anti-influenza_CDR
aucuaccccaacaacggcgugacc

SEQ ID NO: 14518 - RNA, 24 nt, Artificial Sequence
  derived and/or modified sequence opt1 from anti-influenza_CDR
auggagaccgacacccugcuccug

SEQ ID NO: 14519 - RNA, 27 nt, Artificial Sequence
  derived and/or modified sequence opt1 from anti-influenza_CDR
gacggcgugaccaacaaggucaacagc

SEQ ID NO: 14520 - RNA, 27 nt, Artificial Sequence
  derived and/or modified sequence opt1 from anti-influenza_CDR
ggcagcgacgugggguccagcaaccug

SEQ ID NO: 14521 - RNA, 27 nt, Artificial Sequence
  derived and/or modified sequence opt1 from anti-influenza_CDR
augcagaacauccugcucccccugacc

SEQ ID NO: 14522 - RNA, 27 nt, Artificial Sequence
  derived and/or modified sequence opt1 from anti-influenza_CDR
augcagagccugcagcucccccugacc

SEQ ID NO: 14523 - RNA, 27 nt, Artificial Sequence
  derived and/or modified sequence opt1 from anti-influenza_CDR
cagcagcacuaccgcaccccgcccacc

SEQ ID NO: 14524 - RNA, 27 nt, Artificial Sequence
  derived and/or modified sequence opt1 from anti-influenza_CDR
cagcaguacggcaacagccccuacacc

SEQ ID NO: 14525 - RNA, 27 nt, Artificial Sequence
  derived and/or modified sequence opt1 from anti-influenza_CDR
cagcaguacggcagcucccccuacacc

SEQ ID NO: 14526 - RNA, 27 nt, Artificial Sequence
  derived and/or modified sequence opt1 from anti-influenza_CDR
cagcaguacggcaccagcccccagacc

SEQ ID NO: 14527 - RNA, 27 nt, Artificial Sequence
  derived and/or modified sequence opt1 from anti-influenza_CDR
cagcaguacggcuaccugccccucacc

SEQ ID NO: 14528 - RNA, 27 nt, Artificial Sequence
  derived and/or modified sequence opt1 from anti-influenza_CDR
caggccugggacagcuccaccgccgug

SEQ ID NO: 14529 - RNA, 27 nt, Artificial Sequence
  derived and/or modified sequence opt1 from anti-influenza_CDR
cagcacuacaacgccuacuggggcacc

SEQ ID NO: 14530 - RNA, 27 nt, Artificial Sequence
  derived and/or modified sequence opt1 from anti-influenza_CDR
cagcagaccuacagcuccccgcccacc

SEQ ID NO: 14531 - RNA, 27 nt, Artificial Sequence
  derived and/or modified sequence opt1 from anti-influenza_CDR
cagcaguacuacagcuuccccuacacc

SEQ ID NO: 14532 - RNA, 27 nt, Artificial Sequence
  derived and/or modified sequence opt1 from anti-influenza_CDR
augcaggcccugcagcucccccuggcc

SEQ ID NO: 14533 - RNA, 27 nt, Artificial Sequence
  derived and/or modified sequence opt1 from anti-influenza_CDR
cagcaggccaacagcuuccccuucacc

SEQ ID NO: 14534 - RNA, 27 nt, Artificial Sequence
  derived and/or modified sequence opt1 from anti-influenza_CDR
cagcagcugaacggcuacccccucacc

SEQ ID NO: 14535 - RNA, 27 nt, Artificial Sequence
  derived and/or modified sequence opt1 from anti-influenza_CDR
augcaggcccugcagaccccccucacc

SEQ ID NO: 14536 - RNA, 27 nt, Artificial Sequence
  derived and/or modified sequence opt1 from anti-influenza_CDR
cagcagaacuacaacuggccccugacc

SEQ ID NO: 14537 - RNA, 27 nt, Artificial Sequence
  derived and/or modified sequence opt1 from anti-influenza_CDR
cagcaguacgacaccagcuccggccug

SEQ ID NO: 14538 - RNA, 27 nt, Artificial Sequence
  derived and/or modified sequence opt1 from anti-influenza_CDR
cagcaguacaacagcuggccccgcacc

SEQ ID NO: 14539 - RNA, 27 nt, Artificial Sequence
  derived and/or modified sequence opt1 from anti-influenza_CDR
gugaucuacagccacggccgcgccuac

SEQ ID NO: 14540 - RNA, 27 nt, Artificial Sequence
  derived and/or modified sequence opt1 from anti-influenza_CDR
cagcaguacggcgacagccgcuacacc

SEQ ID NO: 14541 - RNA, 27 nt, Artificial Sequence
  derived and/or modified sequence opt1 from anti-influenza_CDR
cugcagcacaacagcuaccccuacacc

SEQ ID NO: 14542 - RNA, 27 nt, Artificial Sequence
  derived and/or modified sequence opt1 from anti-influenza_CDR
cgcaagaugaccaccgccuucgacagc

SEQ ID NO: 14543 - RNA, 27 nt, Artificial Sequence
  derived and/or modified sequence opt1 from anti-influenza_CDR
cagcgcaaccacagccccuccuggacc

SEQ ID NO: 14544 - RNA, 27 nt, Artificial Sequence
  derived and/or modified sequence opt1 from anti-influenza_CDR
cagcagagcuacgacaacccccagacc

SEQ ID NO: 14545 - RNA, 27 nt, Artificial Sequence
  derived and/or modified sequence opt1 from anti-influenza_CDR
cagcagagccgccggcugcccuacacc

SEQ ID NO: 14546 - RNA, 27 nt, Artificial Sequence
  derived and/or modified sequence opt1 from anti-influenza_CDR
cgcaagaugaccaccgccaucgacuac

SEQ ID NO: 14547 - RNA, 27 nt, Artificial Sequence
  derived and/or modified sequence opt1 from anti-influenza_CDR
auccgcuacaccggccagcagcugcuc

SEQ ID NO: 14548 - RNA, 27 nt, Artificial Sequence
  derived and/or modified sequence opt1 from anti-influenza_CDR
cagcacuacggcaccaucagccagacc

SEQ ID NO: 14549 - RNA, 27 nt, Artificial Sequence
  derived and/or modified sequence opt1 from anti-influenza_CDR
cagcaguacagcaccuccccgcccacc

SEQ ID NO: 14550 - RNA, 27 nt, Artificial Sequence
  derived and/or modified sequence opt1 from anti-influenza_CDR
cagcaguacggcaacagccccaucacc

SEQ ID NO: 14551 - RNA, 27 nt, Artificial Sequence
  derived and/or modified sequence opt1 from anti-influenza_CDR
cagcaguacuacagccgccccuacacc

SEQ ID NO: 14552 - RNA, 27 nt, Artificial Sequence
  derived and/or modified sequence opt1 from anti-influenza_CDR
caggugugggacaacuucggcgggguc

SEQ ID NO: 14553 - RNA, 27 nt, Artificial Sequence
  derived and/or modified sequence opt1 from anti-influenza_CDR
cagcagagcuacuccagcccccugacc

SEQ ID NO: 14554 - RNA, 27 nt, Artificial Sequence
  derived and/or modified sequence opt1 from anti-influenza_CDR
cagcaguacuucgccaccccccgcacc

SEQ ID NO: 14555 - RNA, 27 nt, Artificial Sequence
  derived and/or modified sequence opt1 from anti-influenza_CDR
cagcaguacuacuucagcccccugacc

SEQ ID NO: 14556 - RNA, 27 nt, Artificial Sequence
  derived and/or modified sequence opt1 from anti-influenza_CDR
cagcacuucggcaccagcguguucacc

SEQ ID NO: 14557 - RNA, 27 nt, Artificial Sequence
  derived and/or modified sequence opt1 from anti-influenza_CDR
cagcaguacuacaacgccccccugacc

SEQ ID NO: 14558 - RNA, 27 nt, Artificial Sequence
  derived and/or modified sequence opt1 from anti-influenza_CDR
gugcuguucaccagccccuucgacuuc

SEQ ID NO: 14559 - RNA, 27 nt, Artificial Sequence
  derived and/or modified sequence opt1 from anti-influenza_CDR
cugcucagcuacuccggcguguggguc

SEQ ID NO: 14560 - RNA, 27 nt, Artificial Sequence
  derived and/or modified sequence opt1 from anti-influenza_CDR
uuccugagcuacuccggcgccugggug

SEQ ID NO: 14561 - RNA, 27 nt, Artificial Sequence
  derived and/or modified sequence opt1 from anti-influenza_CDR
cagcagagcuucuccaagagcuggacc

SEQ ID NO: 14562 - RNA, 27 nt, Artificial Sequence
  derived and/or modified sequence opt1 from anti-influenza_CDR
gugcaguacguccaguuccccuggacc

SEQ ID NO: 14563 - RNA, 27 nt, Artificial Sequence
  derived and/or modified sequence opt1 from anti-influenza_CDR
cagcagagcuacuccccgccccugacc

SEQ ID NO: 14564 - RNA, 27 nt, Artificial Sequence
  derived and/or modified sequence opt1 from anti-influenza_CDR
uucaucuacuacggcgggaacaccaag

SEQ ID NO: 14565 - RNA, 27 nt, Artificial Sequence
  derived and/or modified sequence opt1 from anti-influenza_CDR
gugaucuacagcggcggguccaccuac

SEQ ID NO: 14566 - RNA, 27 nt, Artificial Sequence
  derived and/or modified sequence opt1 from anti-influenza_CDR
uucauguuccacuccggcagcccccgc

SEQ ID NO: 14567 - RNA, 27 nt, Artificial Sequence
  derived and/or modified sequence opt1 from anti-influenza_CDR
cagcagaccuacagcacccccaucacg

SEQ ID NO: 14568 - RNA, 27 nt, Artificial Sequence
  derived and/or modified sequence opt1 from anti-influenza_CDR
uucuucuacaacggcgggagcaccaag

SEQ ID NO: 14569 - RNA, 27 nt, Artificial Sequence
  derived and/or modified sequence opt1 from anti-influenza_CDR
cagcagagcuacaacaccccccugauc

SEQ ID NO: 14570 - RNA, 27 nt, Artificial Sequence
  derived and/or modified sequence opt1 from anti-influenza_CDR
cacaucuacgacuacggccgcaccuuc

SEQ ID NO: 14571 - RNA, 27 nt, Artificial Sequence
  derived and/or modified sequence opt1 from anti-influenza_CDR
guguucuacagcgagacccgcaccuac

SEQ ID NO: 14572 - RNA, 27 nt, Artificial Sequence
  derived and/or modified sequence opt1 from anti-influenza_CDR
cagguguggggcagcuccagcgaccac

SEQ ID NO: 14573 - RNA, 27 nt, Artificial Sequence
  derived and/or modified sequence opt1 from anti-influenza_CDR
uacguguacaaccgcggcagcaccaag

SEQ ID NO: 14574 - RNA, 27 nt, Artificial Sequence
  derived and/or modified sequence opt1 from anti-influenza_CDR
uacaucuacaaccgcggcagcaccaag

SEQ ID NO: 14575 - RNA, 27 nt, Artificial Sequence
  derived and/or modified sequence opt1 from anti-influenza_CDR
cagcagagcuacaacacccccaucacc

SEQ ID NO: 14576 - RNA, 27 nt, Artificial Sequence
  derived and/or modified sequence opt1 from anti-influenza_CDR
cagcaguacuacagcuccccgcccacc

SEQ ID NO: 14577 - RNA, 27 nt, Artificial Sequence
  derived and/or modified sequence opt1 from anti-influenza_CDR
uaccuguacuacagcggcuccaccaag

SEQ ID NO: 14578 - RNA, 27 nt, Artificial Sequence
  derived and/or modified sequence opt1 from anti-influenza_CDR
cagcagagcuacuccccgcccaucacc

SEQ ID NO: 14579 - RNA, 27 nt, Artificial Sequence
  derived and/or modified sequence opt1 from anti-influenza_CDR
uacguguacaacagcggcaacaccaag

SEQ ID NO: 14580 - RNA, 27 nt, Artificial Sequence
  derived and/or modified sequence opt1 from anti-influenza_CDR
cagcagagcuacaacaccccccugacc

SEQ ID NO: 14581 - RNA, 27 nt, Artificial Sequence
  derived and/or modified sequence opt1 from anti-influenza_CDR
cacaucuucgacagcggcuccaccuac

SEQ ID NO: 14582 - RNA, 27 nt, Artificial Sequence
  derived and/or modified sequence opt1 from anti-influenza_CDR
guguucuacagcgccgaccgcaccucc

SEQ ID NO: 14583 - RNA, 27 nt, Artificial Sequence
  derived and/or modified sequence opt1 from anti-influenza_CDR
cagcaguacuacagcaccccccugacc

SEQ ID NO: 14584 - RNA, 27 nt, Artificial Sequence
  derived and/or modified sequence opt1 from anti-influenza_CDR
uacaucuacuacagcggcaacaccuac

SEQ ID NO: 14585 - RNA, 27 nt, Artificial Sequence
  derived and/or modified sequence opt1 from anti-influenza_CDR
cagcagagcuacuccaccccccugacc

SEQ ID NO: 14586 - RNA, 27 nt, Artificial Sequence
  derived and/or modified sequence opt1 from anti-influenza_CDR
cagcaguacggcagcuccagccugacc

SEQ ID NO: 14587 - RNA, 27 nt, Artificial Sequence
  derived and/or modified sequence opt1 from anti-influenza_CDR
agcuccuacaccagcuccagcaccuac

SEQ ID NO: 14588 - RNA, 27 nt, Artificial Sequence
  derived and/or modified sequence opt1 from anti-influenza_CDR
cagcgcuacaacagcgccccgcccauc

SEQ ID NO: 14589 - RNA, 27 nt, Artificial Sequence
  derived and/or modified sequence opt1 from anti-influenza_CDR
cagcaguacggccgcaccccccugacc

SEQ ID NO: 14590 - RNA, 27 nt, Artificial Sequence
  derived and/or modified sequence opt1 from anti-influenza_CDR
cagcaguacggcuccagcccccgcacc

SEQ ID NO: 14591 - RNA, 27 nt, Artificial Sequence
  derived and/or modified sequence opt1 from anti-influenza_CDR
cagcaguacggcuccagcccccugacc

SEQ ID NO: 14592 - RNA, 27 nt, Artificial Sequence
  derived and/or modified sequence opt1 from anti-influenza_CDR
caggugugggacagcuccagcgaccac

SEQ ID NO: 14593 - RNA, 27 nt, Artificial Sequence
  derived and/or modified sequence opt1 from anti-influenza_CDR
aaggaguucagcgagguggagggccgc

SEQ ID NO: 14594 - RNA, 27 nt, Artificial Sequence
  derived and/or modified sequence opt1 from anti-influenza_CDR
aaggaguucaacaaccuggagaagcgc

SEQ ID NO: 14595 - RNA, 27 nt, Artificial Sequence
  derived and/or modified sequence opt1 from anti-influenza_CDR
cagcagcacuaccgcaccccgcccagc

SEQ ID NO: 14596 - RNA, 27 nt, Artificial Sequence
  derived and/or modified sequence opt1 from anti-influenza_CDR
augcaggccacccacuggccccugacc

SEQ ID NO: 14597 - RNA, 27 nt, Artificial Sequence
  derived and/or modified sequence opt1 from anti-influenza_CDR
cagcaguacuacagcuaccccuacacc

SEQ ID NO: 14598 - RNA, 27 nt, Artificial Sequence
  derived and/or modified sequence opt1 from anti-influenza_CDR
agcuccgacgugggcggguacaacuac

SEQ ID NO: 14599 - RNA, 27 nt, Artificial Sequence
  derived and/or modified sequence opt1 from anti-influenza_CDR
agcuccgacgugggcgacuacaacuac

SEQ ID NO: 14600 - RNA, 27 nt, Artificial Sequence
  derived and/or modified sequence opt1 from anti-influenza_CDR
cagcaguacaacaacuggccccugagc

SEQ ID NO: 14601 - RNA, 27 nt, Artificial Sequence
  derived and/or modified sequence opt1 from anti-influenza_CDR
cagcagagcuacaacuacccccgcacc

SEQ ID NO: 14602 - RNA, 27 nt, Artificial Sequence
  derived and/or modified sequence opt1 from anti-influenza_CDR
augcagggccugcagacccccuacacc

SEQ ID NO: 14603 - RNA, 27 nt, Artificial Sequence
  derived and/or modified sequence opt1 from anti-influenza_CDR
cagcagcacuacagcaucccccugacc

SEQ ID NO: 14604 - RNA, 27 nt, Artificial Sequence
  derived and/or modified sequence opt1 from anti-influenza_CDR
cugcagcacaacagcuaccccuggacc

SEQ ID NO: 14605 - RNA, 27 nt, Artificial Sequence
  derived and/or modified sequence opt1 from anti-influenza_CDR
cagcaguacaacaccuggccccugacc

SEQ ID NO: 14606 - RNA, 27 nt, Artificial Sequence
  derived and/or modified sequence opt1 from anti-influenza_CDR
cagcaguacaacagcuuccccuaccgc

SEQ ID NO: 14607 - RNA, 27 nt, Artificial Sequence
  derived and/or modified sequence opt1 from anti-influenza_CDR
cagcagagcuacuccgcccccuucacc

SEQ ID NO: 14608 - RNA, 27 nt, Artificial Sequence
  derived and/or modified sequence opt1 from anti-influenza_CDR
caggccugggacagcuccaccgugguc

SEQ ID NO: 14609 - RNA, 27 nt, Artificial Sequence
  derived and/or modified sequence opt1 from anti-influenza_CDR
caggccugggacagcaccaccgugguc

SEQ ID NO: 14610 - RNA, 27 nt, Artificial Sequence
  derived and/or modified sequence opt1 from anti-influenza_CDR
cugcaguacggcuccagcccccgcacc

SEQ ID NO: 14611 - RNA, 27 nt, Artificial Sequence
  derived and/or modified sequence opt1 from anti-influenza_CDR
agcuccgacgugggcggguacgacuac

SEQ ID NO: 14612 - RNA, 27 nt, Artificial Sequence
  derived and/or modified sequence opt1 from anti-influenza_CDR
cagcaguacaccuacuggccccugacc

SEQ ID NO: 14613 - RNA, 27 nt, Artificial Sequence
  derived and/or modified sequence opt1 from anti-influenza_CDR
cagcaguacgacaaguggcccccgggc

SEQ ID NO: 14614 - RNA, 27 nt, Artificial Sequence
  derived and/or modified sequence opt1 from anti-influenza_CDR
augcagagccugcagaccuccaucacc

SEQ ID NO: 14615 - RNA, 27 nt, Artificial Sequence
  derived and/or modified sequence opt1 from anti-influenza_CDR
agccagaucgagcuggccgugcuccug

SEQ ID NO: 14616 - RNA, 27 nt, Artificial Sequence
  derived and/or modified sequence opt1 from anti-influenza_CDR
augcaggcccugcagacccccuacacc

SEQ ID NO: 14617 - RNA, 27 nt, Artificial Sequence
  derived and/or modified sequence opt1 from anti-influenza_CDR
cagcagcgcagccacuggcccccgauc

SEQ ID NO: 14618 - RNA, 27 nt, Artificial Sequence
  derived and/or modified sequence opt1 from anti-influenza_CDR
cagcacuucuggggcaccccccugacc

SEQ ID NO: 14619 - RNA, 27 nt, Artificial Sequence
  derived and/or modified sequence opt1 from anti-influenza_CDR
cagcagaacuacgaggaccccuggacc

SEQ ID NO: 14620 - RNA, 27 nt, Artificial Sequence
  derived and/or modified sequence opt1 from anti-influenza_CDR
cagcaggccaacagcuucccgcccacc

SEQ ID NO: 14621 - RNA, 27 nt, Artificial Sequence
  derived and/or modified sequence opt1 from anti-influenza_CDR
cagcagcgcgaccacuggcccccgauc

SEQ ID NO: 14622 - RNA, 27 nt, Artificial Sequence
  derived and/or modified sequence opt1 from anti-influenza_CDR
auggacagccgccugaaccucguguuc

SEQ ID NO: 14623 - RNA, 27 nt, Artificial Sequence
  derived and/or modified sequence opt1 from anti-influenza_CDR
augaagcugcccgugcgccuccugguc

SEQ ID NO: 14624 - RNA, 30 nt, Artificial Sequence
  derived and/or modified sequence opt1 from anti-influenza_CDR
ggcgacagcgugacccgcgggggcuucuac

SEQ ID NO: 14625 - RNA, 30 nt, Artificial Sequence
  derived and/or modified sequence opt1 from anti-influenza_CDR
cagagcgugaccuucaacaacaagaacuac

SEQ ID NO: 14626 - RNA, 30 nt, Artificial Sequence
  derived and/or modified sequence opt1 from anti-influenza_CDR
cagagcgugaccuucaacuacaagaacuac

SEQ ID NO: 14627 - RNA, 30 nt, Artificial Sequence
  derived and/or modified sequence opt1 from anti-influenza_CDR
cgcgcccagagccuguccagcuaccuccac

SEQ ID NO: 14628 - RNA, 30 nt, Artificial Sequence
  derived and/or modified sequence opt1 from anti-influenza_CDR
agcuccuacaccagcuccagcaccuacgug

SEQ ID NO: 14629 - RNA, 30 nt, Artificial Sequence
  derived and/or modified sequence opt1 from anti-influenza_CDR
cagcgcuacaacagcgccccgcccaucacc

SEQ ID NO: 14630 - RNA, 30 nt, Artificial Sequence
  derived and/or modified sequence opt1 from anti-influenza_CDR
ggcgggagcaucuccagcggcaccuacuac

SEQ ID NO: 14631 - RNA, 30 nt, Artificial Sequence
  derived and/or modified sequence opt1 from anti-influenza_CDR
cagcagagcuacuccagccugauguucacc

SEQ ID NO: 14632 - RNA, 30 nt, Artificial Sequence
  derived and/or modified sequence opt1 from anti-influenza_CDR
cugcucaucuacggcgccagcacccgcgcc

SEQ ID NO: 14633 - RNA, 30 nt, Artificial Sequence
  derived and/or modified sequence opt1 from anti-influenza_CDR
ugcgccuacggcgggaaguaccuggugguc

SEQ ID NO: 14634 - RNA, 30 nt, Artificial Sequence
  derived and/or modified sequence opt1 from anti-influenza_CDR
cgccccgacuucuacggcgacuucgaguac

SEQ ID NO: 14635 - RNA, 30 nt, Artificial Sequence
  derived and/or modified sequence opt1 from anti-influenza_CDR
cagcacuacggcuacagcccccgcuacgcc

SEQ ID NO: 14636 - RNA, 30 nt, Artificial Sequence
  derived and/or modified sequence opt1 from anti-influenza_CDR
cagcagcgcagccacuggcccccgaucacc

SEQ ID NO: 14637 - RNA, 30 nt, Artificial Sequence
  derived and/or modified sequence opt1 from anti-influenza_CDR
agcuccuacgccggcagcuccaccugggug

SEQ ID NO: 14638 - RNA, 30 nt, Artificial Sequence
  derived and/or modified sequence opt1 from anti-influenza_CDR
cugcucuacagcggcggggaccccguggcc

SEQ ID NO: 14639 - RNA, 30 nt, Artificial Sequence
  derived and/or modified sequence opt1 from anti-influenza_CDR
cagcaguacggcgggagcccccgcuacacc

SEQ ID NO: 14640 - RNA, 30 nt, Artificial Sequence
  derived and/or modified sequence opt1 from anti-influenza_CDR
cgcuacggcagcggguacggcuucgacucc

SEQ ID NO: 14641 - RNA, 30 nt, Artificial Sequence
  derived and/or modified sequence opt1 from anti-influenza_CDR
agcuccuacgccggcaacuacaaccacgug

SEQ ID NO: 14642 - RNA, 30 nt, Artificial Sequence
  derived and/or modified sequence opt1 from anti-influenza_CDR
cagcaguacaucaacuggcgcccccugagc

SEQ ID NO: 14643 - RNA, 30 nt, Artificial Sequence
  derived and/or modified sequence opt1 from anti-influenza_CDR
aucggcgccggguacgacgugcacugguac

SEQ ID NO: 14644 - RNA, 30 nt, Artificial Sequence
  derived and/or modified sequence opt1 from anti-influenza_CDR
cugcucaucuacgacaacaacaaccgcccc

SEQ ID NO: 14645 - RNA, 30 nt, Artificial Sequence
  derived and/or modified sequence opt1 from anti-influenza_CDR
cagagcuacgacaacucccugagcggcucc

SEQ ID NO: 14646 - RNA, 30 nt, Artificial Sequence
  derived and/or modified sequence opt1 from anti-influenza_CDR
cugcucaucuacgacgccagcaaccugcag

SEQ ID NO: 14647 - RNA, 30 nt, Artificial Sequence
  derived and/or modified sequence opt1 from anti-influenza_CDR
cugcucauccacgacgccagcaaccuggag

SEQ ID NO: 14648 - RNA, 30 nt, Artificial Sequence
  derived and/or modified sequence opt1 from anti-influenza_CDR
gugcagcgccugagcuacggcauggacguc

SEQ ID NO: 14649 - RNA, 30 nt, Artificial Sequence
  derived and/or modified sequence opt1 from anti-influenza_CDR
gugcagaagagcuacuacggcauggacguc

SEQ ID NO: 14650 - RNA, 30 nt, Artificial Sequence
  derived and/or modified sequence opt1 from anti-influenza_CDR
agcuccuacaccagcuccagcacccacgug

SEQ ID NO: 14651 - RNA, 30 nt, Artificial Sequence
  derived and/or modified sequence opt1 from anti-influenza_CDR
agcuccuacaccagcuccagcacccuggug

SEQ ID NO: 14652 - RNA, 30 nt, Artificial Sequence
  derived and/or modified sequence opt1 from anti-influenza_CDR
accaagcgcagccagcagaccgugaucccc

SEQ ID NO: 14653 - RNA, 30 nt, Artificial Sequence
  derived and/or modified sequence opt1 from anti-influenza_CDR
accagccgcucccagcagaccgugaucccc

SEQ ID NO: 14654 - RNA, 30 nt, Artificial Sequence
  derived and/or modified sequence opt1 from anti-influenza_CDR
agcuccaacuacaaccgccgguucaccccc

SEQ ID NO: 14655 - RNA, 30 nt, Artificial Sequence
  derived and/or modified sequence opt1 from anti-influenza_CDR
cgccccaaggugcgggaccaggagagccgc

SEQ ID NO: 14656 - RNA, 30 nt, Artificial Sequence
  derived and/or modified sequence opt1 from anti-influenza_CDR
cgccccugggugcggggcgucagcucccgc

SEQ ID NO: 14657 - RNA, 30 nt, Artificial Sequence
  derived and/or modified sequence opt1 from anti-influenza_CDR
cgccccugggugcggggccugagcucccgc

SEQ ID NO: 14658 - RNA, 30 nt, Artificial Sequence
  derived and/or modified sequence opt1 from anti-influenza_CDR
cgccccaaggugcggggccaggccgggcgc

SEQ ID NO: 14659 - RNA, 30 nt, Artificial Sequence
  derived and/or modified sequence opt1 from anti-influenza_CDR
gcccccgccguggcggcccaggccagcgcc

SEQ ID NO: 14660 - RNA, 30 nt, Artificial Sequence
  derived and/or modified sequence opt1 from anti-influenza_CDR
gugcaccaccccggcaccgacaacgaccag

SEQ ID NO: 14661 - RNA, 30 nt, Artificial Sequence
  derived and/or modified sequence opt1 from anti-influenza_CDR
uucggccaggggaccaagguggagaucaag

SEQ ID NO: 14662 - RNA, 30 nt, Artificial Sequence
  derived and/or modified sequence opt1 from anti-influenza_CDR
ggcuucgccuuccacaaccgcgccaugcac

SEQ ID NO: 14663 - RNA, 30 nt, Artificial Sequence
  derived and/or modified sequence opt1 from anti-influenza_CDR
ggccugaccuucagcuccuacgccgugcac

SEQ ID NO: 14664 - RNA, 30 nt, Artificial Sequence
  derived and/or modified sequence opt1 from anti-influenza_CDR
ggccccaccuucagcuccuacgccgugcac

SEQ ID NO: 14665 - RNA, 30 nt, Artificial Sequence
  derived and/or modified sequence opt1 from anti-influenza_CDR
ggcagcaucuucuccaacuacgggaucagc

SEQ ID NO: 14666 - RNA, 30 nt, Artificial Sequence
  derived and/or modified sequence opt1 from anti-influenza_CDR
ggcuacagcuucaacaacuacgggaucaac

SEQ ID NO: 14667 - RNA, 30 nt, Artificial Sequence
  derived and/or modified sequence opt1 from anti-influenza_CDR
ggcuacaccuucaacgccuacuacauccac

SEQ ID NO: 14668 - RNA, 30 nt, Artificial Sequence
  derived and/or modified sequence opt1 from anti-influenza_CDR
ggcuacaccuucaccagcuucaucauguac

SEQ ID NO: 14669 - RNA, 30 nt, Artificial Sequence
  derived and/or modified sequence opt1 from anti-influenza_CDR
cgcggcaacuacgggaacggcuucgccuac

SEQ ID NO: 14670 - RNA, 30 nt, Artificial Sequence
  derived and/or modified sequence opt1 from anti-influenza_CDR
cagcaguacggcagcucccccgcccugacc

SEQ ID NO: 14671 - RNA, 30 nt, Artificial Sequence
  derived and/or modified sequence opt1 from anti-influenza_CDR
caggaguacaacaacgacagcccccugacc

SEQ ID NO: 14672 - RNA, 30 nt, Artificial Sequence
  derived and/or modified sequence opt1 from anti-influenza_CDR
auccgcagcggccugaaccgguucgagacc

SEQ ID NO: 14673 - RNA, 30 nt, Artificial Sequence
  derived and/or modified sequence opt1 from anti-influenza_CDR
guguucuacagcggcuccagcaacuacaac

SEQ ID NO: 14674 - RNA, 30 nt, Artificial Sequence
  derived and/or modified sequence opt1 from anti-influenza_CDR
ggcgccagcaucuccaccgggggcaacuac

SEQ ID NO: 14675 - RNA, 30 nt, Artificial Sequence
  derived and/or modified sequence opt1 from anti-influenza_CDR
aucuucuacagcggcaccaccaaguacaac

SEQ ID NO: 14676 - RNA, 30 nt, Artificial Sequence
  derived and/or modified sequence opt1 from anti-influenza_CDR
gccagcuacgccggcaccuacauccaccug

SEQ ID NO: 14677 - RNA, 30 nt, Artificial Sequence
  derived and/or modified sequence opt1 from anti-influenza_CDR
cagcagcugaacagcuacccgcccaucacc

SEQ ID NO: 14678 - RNA, 30 nt, Artificial Sequence
  derived and/or modified sequence opt1 from anti-influenza_CDR
cagcaguucaacgacuggcccuuccugacc

SEQ ID NO: 14679 - RNA, 30 nt, Artificial Sequence
  derived and/or modified sequence opt1 from anti-influenza_CDR
cagcagcugaccaccuacccgcccaucacg

SEQ ID NO: 14680 - RNA, 30 nt, Artificial Sequence
  derived and/or modified sequence opt1 from anti-influenza_CDR
ggcgggagcaucuccaacggcggguaccac

SEQ ID NO: 14681 - RNA, 30 nt, Artificial Sequence
  derived and/or modified sequence opt1 from anti-influenza_CDR
ggcgacagcgugaucaacuccgccuacuac

SEQ ID NO: 14682 - RNA, 30 nt, Artificial Sequence
  derived and/or modified sequence opt1 from anti-influenza_CDR
cagcaguacgacaacuggcugcccaucacc

SEQ ID NO: 14683 - RNA, 30 nt, Artificial Sequence
  derived and/or modified sequence opt1 from anti-influenza_CDR
gccggcgacuacagcgggggcaucuacgcc

SEQ ID NO: 14684 - RNA, 30 nt, Artificial Sequence
  derived and/or modified sequence opt1 from anti-influenza_CDR
gccggcgacuacagcggguccaacuacgcc

SEQ ID NO: 14685 - RNA, 30 nt, Artificial Sequence
  derived and/or modified sequence opt1 from anti-influenza_CDR
gccggcgacuacagcggggccaacuacgcg

SEQ ID NO: 14686 - RNA, 30 nt, Artificial Sequence
  derived and/or modified sequence opt1 from anti-influenza_CDR
ggccugagccucuacuccaacgagaucaac

SEQ ID NO: 14687 - RNA, 30 nt, Artificial Sequence
  derived and/or modified sequence opt1 from anti-influenza_CDR
gccagcuacgccggcaacaacaucuacgug

SEQ ID NO: 14688 - RNA, 30 nt, Artificial Sequence
  derived and/or modified sequence opt1 from anti-influenza_CDR
gccagccaguccgugagcaccuuccuggcc

SEQ ID NO: 14689 - RNA, 30 nt, Artificial Sequence
  derived and/or modified sequence opt1 from anti-influenza_CDR
aucaagagcaacaccgacggcgggaccacg

SEQ ID NO: 14690 - RNA, 30 nt, Artificial Sequence
  derived and/or modified sequence opt1 from anti-influenza_CDR
gagagcguggacaucuacggcaacuccuuc

SEQ ID NO: 14691 - RNA, 30 nt, Artificial Sequence
  derived and/or modified sequence opt1 from anti-influenza_CDR
gagagcaucgacaucuacggcaacuccuuc

SEQ ID NO: 14692 - RNA, 30 nt, Artificial Sequence
  derived and/or modified sequence opt1 from anti-influenza_CDR
gccggcgacuacagcggggugaacuacgcc

SEQ ID NO: 14693 - RNA, 33 nt, Artificial Sequence
  derived and/or modified sequence opt1 from anti-influenza_CDR
gccgccugggacgacagccugaacggccagcuc

SEQ ID NO: 14694 - RNA, 33 nt, Artificial Sequence
  derived and/or modified sequence opt1 from anti-influenza_CDR
ugcagcuacgccggcuccagcuccagccgcgug

SEQ ID NO: 14695 - RNA, 33 nt, Artificial Sequence
  derived and/or modified sequence opt1 from anti-influenza_CDR
cuggugcucgccaccggccugcgcaacagcccc

SEQ ID NO: 14696 - RNA, 33 nt, Artificial Sequence
  derived and/or modified sequence opt1 from anti-influenza_CDR
cagagccugcuccacuccgacggcaagaccuac

SEQ ID NO: 14697 - RNA, 33 nt, Artificial Sequence
  derived and/or modified sequence opt1 from anti-influenza_CDR
cgcaccagccagucccugagcuccuaccuccac

SEQ ID NO: 14698 - RNA, 33 nt, Artificial Sequence
  derived and/or modified sequence opt1 from anti-influenza_CDR
cgcgccagccagcggcugaacuccuaccuccac

SEQ ID NO: 14699 - RNA, 33 nt, Artificial Sequence
  derived and/or modified sequence opt1 from anti-influenza_CDR
cgcaccagccagucccugcggagcuaccuccac

SEQ ID NO: 14700 - RNA, 33 nt, Artificial Sequence
  derived and/or modified sequence opt1 from anti-influenza_CDR
cgcaccagccagucccugagcuccuacacccac

SEQ ID NO: 14701 - RNA, 33 nt, Artificial Sequence
  derived and/or modified sequence opt1 from anti-influenza_CDR
cgcaccagccagucccugagcuccuacgaccac

SEQ ID NO: 14702 - RNA, 33 nt, Artificial Sequence
  derived and/or modified sequence opt1 from anti-influenza_CDR
caggugugggacagcuccagcgaccacuacguc

SEQ ID NO: 14703 - RNA, 33 nt, Artificial Sequence
  derived and/or modified sequence opt1 from anti-influenza_CDR
cagguguggggcagcuccagcgaccacuacguc

SEQ ID NO: 14704 - RNA, 33 nt, Artificial Sequence
  derived and/or modified sequence opt1 from anti-influenza_CDR
ggcaccugggacagcucccugagcguggggaug

SEQ ID NO: 14705 - RNA, 33 nt, Artificial Sequence
  derived and/or modified sequence opt1 from anti-influenza_CDR
cagagccugcuccacggcaacggguacaacuac

SEQ ID NO: 14706 - RNA, 33 nt, Artificial Sequence
  derived and/or modified sequence opt1 from anti-influenza_CDR
cgcgccagccagggcauccggaacgaccugggg

SEQ ID NO: 14707 - RNA, 33 nt, Artificial Sequence
  derived and/or modified sequence opt1 from anti-influenza_CDR
cgcgccagccagaacauccgguccuaccugaac

SEQ ID NO: 14708 - RNA, 33 nt, Artificial Sequence
  derived and/or modified sequence opt1 from anti-influenza_CDR
cgcgccaaccaggacaucggcaucuaccugaac

SEQ ID NO: 14709 - RNA, 33 nt, Artificial Sequence
  derived and/or modified sequence opt1 from anti-influenza_CDR
cgcgccagccaguccgugagcaacaaccuggcc

SEQ ID NO: 14710 - RNA, 33 nt, Artificial Sequence
  derived and/or modified sequence opt1 from anti-influenza_CDR
cagcaguaccacaacuggcccccgagcuacucc

SEQ ID NO: 14711 - RNA, 33 nt, Artificial Sequence
  derived and/or modified sequence opt1 from anti-influenza_CDR
cgcgccagccagggcauccugaacugccucgcc

SEQ ID NO: 14712 - RNA, 33 nt, Artificial Sequence
  derived and/or modified sequence opt1 from anti-influenza_CDR
cgcgccagccaguccaucgccagcuggcuggcg

SEQ ID NO: 14713 - RNA, 33 nt, Artificial Sequence
  derived and/or modified sequence opt1 from anti-influenza_CDR
gccccccgcguguacgaguacuacuucgaccag

SEQ ID NO: 14714 - RNA, 33 nt, Artificial Sequence
  derived and/or modified sequence opt1 from anti-influenza_CDR
cgcgccagccaguccgugagcuccuaccuggcc

SEQ ID NO: 14715 - RNA, 33 nt, Artificial Sequence
  derived and/or modified sequence opt1 from anti-influenza_CDR
agcggcgacgcccugcccaagcagaacgccuac

SEQ ID NO: 14716 - RNA, 33 nt, Artificial Sequence
  derived and/or modified sequence opt1 from anti-influenza_CDR
cagagcgccgacuccagcggcaccuccugggug

SEQ ID NO: 14717 - RNA, 33 nt, Artificial Sequence
  derived and/or modified sequence opt1 from anti-influenza_CDR
ggcgggagcaacaucggcgggaaguccgugcac

SEQ ID NO: 14718 - RNA, 33 nt, Artificial Sequence
  derived and/or modified sequence opt1 from anti-influenza_CDR
cagcacuacggcuccagcccccgcuacgccuuc

SEQ ID NO: 14719 - RNA, 33 nt, Artificial Sequence
  derived and/or modified sequence opt1 from anti-influenza_CDR
cgcgccagccaguccaucagcuccuaccugaac

SEQ ID NO: 14720 - RNA, 33 nt, Artificial Sequence
  derived and/or modified sequence opt1 from anti-influenza_CDR
ggcgggaacgccaucggcagcaagaaggugcac

SEQ ID NO: 14721 - RNA, 33 nt, Artificial Sequence
  derived and/or modified sequence opt1 from anti-influenza_CDR
caggugugggacuucaccaucgaccacgucgug

SEQ ID NO: 14722 - RNA, 33 nt, Artificial Sequence
  derived and/or modified sequence opt1 from anti-influenza_CDR
gccaccugggacggcagccuguccgccugggug

SEQ ID NO: 14723 - RNA, 33 nt, Artificial Sequence
  derived and/or modified sequence opt1 from anti-influenza_CDR
cgcgccagccaguccgugggcaacuaccuggcc

SEQ ID NO: 14724 - RNA, 33 nt, Artificial Sequence
  derived and/or modified sequence opt1 from anti-influenza_CDR
cagcagcgcagcaaguggcccccgauguacucc

SEQ ID NO: 14725 - RNA, 33 nt, Artificial Sequence
  derived and/or modified sequence opt1 from anti-influenza_CDR
gacgugagcaccaccugguccugguucgccccc

SEQ ID NO: 14726 - RNA, 33 nt, Artificial Sequence
  derived and/or modified sequence opt1 from anti-influenza_CDR
cgcgccagccagaacaucaagcgguacuucaac

SEQ ID NO: 14727 - RNA, 33 nt, Artificial Sequence
  derived and/or modified sequence opt1 from anti-influenza_CDR
cgcgccagccaguccgugggcaacagccuggcc

SEQ ID NO: 14728 - RNA, 33 nt, Artificial Sequence
  derived and/or modified sequence opt1 from anti-influenza_CDR
ggcgagagcacccuguccuacuacgccgugagc

SEQ ID NO: 14729 - RNA, 33 nt, Artificial Sequence
  derived and/or modified sequence opt1 from anti-influenza_CDR
cgcgccagccagaacaucuacaaguaccugaac

SEQ ID NO: 14730 - RNA, 33 nt, Artificial Sequence
  derived and/or modified sequence opt1 from anti-influenza_CDR
gccagcugcuccggcggguacugcauccuggac

SEQ ID NO: 14731 - RNA, 33 nt, Artificial Sequence
  derived and/or modified sequence opt1 from anti-influenza_CDR
cgcaccagccaguccaucagcuccuaccugaac

SEQ ID NO: 14732 - RNA, 33 nt, Artificial Sequence
  derived and/or modified sequence opt1 from anti-influenza_CDR
cgcgccagccaguccaucggcgccuacgugaac

SEQ ID NO: 14733 - RNA, 33 nt, Artificial Sequence
  derived and/or modified sequence opt1 from anti-influenza_CDR
cgcgccagccaguccaucagcaccuaccugaac

SEQ ID NO: 14734 - RNA, 33 nt, Artificial Sequence
  derived and/or modified sequence opt1 from anti-influenza_CDR
cgcgccagccaguccaucgacaaguuccugaac

SEQ ID NO: 14735 - RNA, 33 nt, Artificial Sequence
  derived and/or modified sequence opt1 from anti-influenza_CDR
ggcgggcacaacaucggcagcaacuccgugcac

SEQ ID NO: 14736 - RNA, 33 nt, Artificial Sequence
  derived and/or modified sequence opt1 from anti-influenza_CDR
cgcgccagccaguccaucagcaccuaccugcac

SEQ ID NO: 14737 - RNA, 33 nt, Artificial Sequence
  derived and/or modified sequence opt1 from anti-influenza_CDR
cacgugggcgggcacaccuacggcaucgacuac

SEQ ID NO: 14738 - RNA, 33 nt, Artificial Sequence
  derived and/or modified sequence opt1 from anti-influenza_CDR
cgcgccagccaguccaucagcaacuaccugaac

SEQ ID NO: 14739 - RNA, 33 nt, Artificial Sequence
  derived and/or modified sequence opt1 from anti-influenza_CDR
cacgacgacgccagccacggcuacuccaucagc

SEQ ID NO: 14740 - RNA, 33 nt, Artificial Sequence
  derived and/or modified sequence opt1 from anti-influenza_CDR
cgcgccagccagaccaucuccaccuaccugaac

SEQ ID NO: 14741 - RNA, 33 nt, Artificial Sequence
  derived and/or modified sequence opt1 from anti-influenza_CDR
cgcgccagccaguccaucagccgguaccugaac

SEQ ID NO: 14742 - RNA, 33 nt, Artificial Sequence
  derived and/or modified sequence opt1 from anti-influenza_CDR
ggcaccugggacagcucccugagcgccuacgug

SEQ ID NO: 14743 - RNA, 33 nt, Artificial Sequence
  derived and/or modified sequence opt1 from anti-influenza_CDR
agcuccaacuacuacgacagcguguacgacuac

SEQ ID NO: 14744 - RNA, 33 nt, Artificial Sequence
  derived and/or modified sequence opt1 from anti-influenza_CDR
gccgccugggacgacauccugaacgugcccguc

SEQ ID NO: 14745 - RNA, 33 nt, Artificial Sequence
  derived and/or modified sequence opt1 from anti-influenza_CDR
guggccugggacgacagcgucgacggcuacgug

SEQ ID NO: 14746 - RNA, 33 nt, Artificial Sequence
  derived and/or modified sequence opt1 from anti-influenza_CDR
ggccccaaguacuacagcgaguacauggacgug

SEQ ID NO: 14747 - RNA, 33 nt, Artificial Sequence
  derived and/or modified sequence opt1 from anti-influenza_CDR
cgcgccagccagggcaucuccagcuaccuggcc

SEQ ID NO: 14748 - RNA, 33 nt, Artificial Sequence
  derived and/or modified sequence opt1 from anti-influenza_CDR
agcuccggcuacuaccccgaguacuuccaggac

SEQ ID NO: 14749 - RNA, 33 nt, Artificial Sequence
  derived and/or modified sequence opt1 from anti-influenza_CDR
agcggccacaagcugggggacaaguacgugucc

SEQ ID NO: 14750 - RNA, 33 nt, Artificial Sequence
  derived and/or modified sequence opt1 from anti-influenza_CDR
agcaccggcuacuaccccgccuaccugcaccac

SEQ ID NO: 14751 - RNA, 33 nt, Artificial Sequence
  derived and/or modified sequence opt1 from anti-influenza_CDR
cgcgccagccagcggguguccagcuaccuggcc

SEQ ID NO: 14752 - RNA, 33 nt, Artificial Sequence; identical to SEQ ID NO: 13645
  derived and/or modified sequence opt1 from anti-influenza_CDR

SEQ ID NO: 14753 - RNA, 33 nt, Artificial Sequence
  derived and/or modified sequence opt1 from anti-influenza_CDR
caggugugggacagcuccagcgaccacgccguc

SEQ ID NO: 14754 - RNA, 33 nt, Artificial Sequence
  derived and/or modified sequence opt1 from anti-influenza_CDR
gccaccugggacgacaaccugagcggccccgug

SEQ ID NO: 14755 - RNA, 33 nt, Artificial Sequence
  derived and/or modified sequence opt1 from anti-influenza_CDR
agcuccggcuacuaccccgccuaccugccgcac

SEQ ID NO: 14756 - RNA, 33 nt, Artificial Sequence
  derived and/or modified sequence opt1 from anti-influenza_CDR
ggcgggaacaacaucggcagcaagggggugcac

SEQ ID NO: 14757 - RNA, 33 nt, Artificial Sequence
  derived and/or modified sequence opt1 from anti-influenza_CDR
caggugugggacagcuccagcgaccacgucgug

SEQ ID NO: 14758 - RNA, 33 nt, Artificial Sequence
  derived and/or modified sequence opt1 from anti-influenza_CDR
ggcaacuacuacuacgagagcucccuggacuac

SEQ ID NO: 14759 - RNA, 33 nt, Artificial Sequence
  derived and/or modified sequence opt1 from anti-influenza_CDR
ggcccccacuacuacagcuccuacauggacgug

SEQ ID NO: 14760 - RNA, 33 nt, Artificial Sequence
  derived and/or modified sequence opt1 from anti-influenza_CDR
cgcgccagccagggcaucuccaccuaccuggcc

SEQ ID NO: 14761 - RNA, 33 nt, Artificial Sequence
  derived and/or modified sequence opt1 from anti-influenza_CDR
ggccccaccuacuacuacagcuacauggacgug

SEQ ID NO: 14762 - RNA, 33 nt, Artificial Sequence
  derived and/or modified sequence opt1 from anti-influenza_CDR
ggcgggaacaacaucggccgcaacagcgugcac

SEQ ID NO: 14763 - RNA, 33 nt, Artificial Sequence
  derived and/or modified sequence opt1 from anti-influenza_CDR
cagguguggcacagcuccagcgaccacuacguc

SEQ ID NO: 14764 - RNA, 33 nt, Artificial Sequence
  derived and/or modified sequence opt1 from anti-influenza_CDR
agcuccggcuacuacccccaguacuuccaggac

SEQ ID NO: 14765 - RNA, 33 nt, Artificial Sequence
  derived and/or modified sequence opt1 from anti-influenza_CDR
cgcgccagccaguccgugagccgguaccuggcc

SEQ ID NO: 14766 - RNA, 33 nt, Artificial Sequence
  derived and/or modified sequence opt1 from anti-influenza_CDR
uggggccaggggaccacccugacggugagcucc

SEQ ID NO: 14767 - RNA, 33 nt, Artificial Sequence
  derived and/or modified sequence opt1 from anti-influenza_CDR
cgcgccagccaguccguggacagcaaccuggcc

SEQ ID NO: 14768 - RNA, 33 nt, Artificial Sequence
  derived and/or modified sequence opt1 from anti-influenza_CDR
cgcgccagccaguccgugagccacaaccuggcc

SEQ ID NO: 14769 - RNA, 33 nt, Artificial Sequence
  derived and/or modified sequence opt1 from anti-influenza_CDR
cgcgccagccaguccgugagcuccaaccuggcc

SEQ ID NO: 14770 - RNA, 33 nt, Artificial Sequence
  derived and/or modified sequence opt1 from anti-influenza_CDR
cgcgccagccaguccguggaccacaaccuggcc

SEQ ID NO: 14771 - RNA, 33 nt, Artificial Sequence
  derived and/or modified sequence opt1 from anti-influenza_CDR
cagcacuacaccaacuggcccccgcgccugacc

SEQ ID NO: 14772 - RNA, 33 nt, Artificial Sequence
  derived and/or modified sequence opt1 from anti-influenza_CDR
cagcacuacaccaacuacccgccccgccugacc

SEQ ID NO: 14773 - RNA, 33 nt, Artificial Sequence
  derived and/or modified sequence opt1 from anti-influenza_CDR
cagcacuacaccaacuucccgccccgccugacc

SEQ ID NO: 14774 - RNA, 33 nt, Artificial Sequence
  derived and/or modified sequence opt1 from anti-influenza_CDR
cgcgccagccaggugaucucccacaaccuggcc

SEQ ID NO: 14775 - RNA, 33 nt, Artificial Sequence
  derived and/or modified sequence opt1 from anti-influenza_CDR
cagcacuacagcaacuggcccccgcgccugacc

SEQ ID NO: 14776 - RNA, 33 nt, Artificial Sequence
  derived and/or modified sequence opt1 from anti-influenza_CDR
cagcacuacagcaacuucccgccccgccugacc

SEQ ID NO: 14777 - RNA, 33 nt, Artificial Sequence
  derived and/or modified sequence opt1 from anti-influenza_CDR
cagcacuacagcaacuacccgccccgccugacc

SEQ ID NO: 14778 - RNA, 33 nt, Artificial Sequence
  derived and/or modified sequence opt1 from anti-influenza_CDR
cgcgccagccaguccguggccaacaaccuggcg

SEQ ID NO: 14779 - RNA, 33 nt, Artificial Sequence
  derived and/or modified sequence opt1 from anti-influenza_CDR
cagcaguacaacaacuggcccccgauguacacc

SEQ ID NO: 14780 - RNA, 33 nt, Artificial Sequence
  derived and/or modified sequence opt1 from anti-influenza_CDR
cgcgccagccaguccaucggcaacuggcuggcc

SEQ ID NO: 14781 - RNA, 33 nt, Artificial Sequence
  derived and/or modified sequence opt1 from anti-influenza_CDR
cagcgcuacaccagcaacucccagggcuucacc

SEQ ID NO: 14782 - RNA, 33 nt, Artificial Sequence
  derived and/or modified sequence opt1 from anti-influenza_CDR
gccgccugggacgacacccugaacggccccgug

SEQ ID NO: 14783 - RNA, 33 nt, Artificial Sequence
  derived and/or modified sequence opt1 from anti-influenza_CDR
aaggccagccagaacgugggcuccaacgucgcc

SEQ ID NO: 14784 - RNA, 33 nt, Artificial Sequence
  derived and/or modified sequence opt1 from anti-influenza_CDR
caggugugggacaugagcuccgaccgccggguc

SEQ ID NO: 14785 - RNA, 33 nt, Artificial Sequence
  derived and/or modified sequence opt1 from anti-influenza_CDR
cagagccugcuccacuccaacggcuacaacuac

SEQ ID NO: 14786 - RNA, 33 nt, Artificial Sequence
  derived and/or modified sequence opt1 from anti-influenza_CDR
accuaccuggugggcgccgucggguuccagcac

SEQ ID NO: 14787 - RNA, 33 nt, Artificial Sequence; identical to SEQ ID NO: 13698
  derived and/or modified sequence opt1 from anti-influenza_CDR

SEQ ID NO: 14788 - RNA, 33 nt, Artificial Sequence
  derived and/or modified sequence opt1 from anti-influenza_CDR
cagagccugcucgacuccaacggcuacaacuac

SEQ ID NO: 14789 - RNA, 33 nt, Artificial Sequence
  derived and/or modified sequence opt1 from anti-influenza_CDR
augcaggcccugcagaccccgcccauguacacc

SEQ ID NO: 14790 - RNA, 33 nt, Artificial Sequence
  derived and/or modified sequence opt1 from anti-influenza_CDR
cagagccugcuccacuccaacggcuacaaccac

SEQ ID NO: 14791 - RNA, 33 nt, Artificial Sequence
  derived and/or modified sequence opt1 from anti-influenza_CDR
caggugugggacaucaccagcgaccuggucgug

SEQ ID NO: 14792 - RNA, 33 nt, Artificial Sequence
  derived and/or modified sequence opt1 from anti-influenza_CDR
cgcgccagccaggacaucuccaccuggcuggcc

SEQ ID NO: 14793 - RNA, 33 nt, Artificial Sequence
  derived and/or modified sequence opt1 from anti-influenza_CDR
cgcgccagccgguccaucaccaccuuccuggcc

SEQ ID NO: 14794 - RNA, 33 nt, Artificial Sequence
  derived and/or modified sequence opt1 from anti-influenza_CDR
ggguggggcgccgugaccagccccuucgacuuc

SEQ ID NO: 14795 - RNA, 33 nt, Artificial Sequence
  derived and/or modified sequence opt1 from anti-influenza_CDR
cgcgccagccaguccgugagcuccagcuaccug

SEQ ID NO: 14796 - RNA, 36 nt, Artificial Sequence
  derived and/or modified sequence opt1 from anti-influenza_CDR
cagagcgugcuguacuccagcaacaacaagaacuac

SEQ ID NO: 14797 - RNA, 36 nt, Artificial Sequence
  derived and/or modified sequence opt1 from anti-influenza_CDR
gccgccugggacgacagccuguccggcagcugggug

SEQ ID NO: 14798 - RNA, 36 nt, Artificial Sequence
  derived and/or modified sequence opt1 from anti-influenza_CDR
guguucuacagcgccgaccgcaccuccuacgccgac

SEQ ID NO: 14799 - RNA, 36 nt, Artificial Sequence
  derived and/or modified sequence opt1 from anti-influenza_CDR
cgcgugggccagagcgucuccgggagccaccuggcc

SEQ ID NO: 14800 - RNA, 36 nt, Artificial Sequence
  derived and/or modified sequence opt1 from anti-influenza_CDR
acccugagcuccgccuacagcaacuacaagguggac

SEQ ID NO: 14801 - RNA, 36 nt, Artificial Sequence
  derived and/or modified sequence opt1 from anti-influenza_CDR
gugggcaccgggggcaucgucgggagcaagggcgac

SEQ ID NO: 14802 - RNA, 36 nt, Artificial Sequence
  derived and/or modified sequence opt1 from anti-influenza_CDR
cgcuacagccgguccagccccggcaccuucgagucc

SEQ ID NO: 14803 - RNA, 36 nt, Artificial Sequence
  derived and/or modified sequence opt1 from anti-influenza_CDR
cagagcuacgacuccagccuguccggcuuccacgug

SEQ ID NO: 14804 - RNA, 36 nt, Artificial Sequence
  derived and/or modified sequence opt1 from anti-influenza_CDR
cgcgccagccaguccgugagcuccagccagcuggcc

SEQ ID NO: 14805 - RNA, 36 nt, Artificial Sequence
  derived and/or modified sequence opt1 from anti-influenza_CDR
cgcgccagccaguucguguccacccggagccuggcc

SEQ ID NO: 14806 - RNA, 36 nt, Artificial Sequence
  derived and/or modified sequence opt1 from anti-influenza_CDR
gccaccugggacgacagccugaacggcuucuacgug

SEQ ID NO: 14807 - RNA, 36 nt, Artificial Sequence
  derived and/or modified sequence opt1 from anti-influenza_CDR
cgcgccagccacuucgugaacuaccggucccuggcc

SEQ ID NO: 14808 - RNA, 36 nt, Artificial Sequence
  derived and/or modified sequence opt1 from anti-influenza_CDR
cgcgccagccacuucgugaucggccgggccgucgcg

SEQ ID NO: 14809 - RNA, 36 nt, Artificial Sequence
  derived and/or modified sequence opt1 from anti-influenza_CDR
cgcaucuaccacggcgggaacagcggcuucgacuuc

SEQ ID NO: 14810 - RNA, 36 nt, Artificial Sequence
  derived and/or modified sequence opt1 from anti-influenza_CDR
acccugagcuccggcuucgacaacuaccagguggcc

SEQ ID NO: 14811 - RNA, 36 nt, Artificial Sequence
  derived and/or modified sequence opt1 from anti-influenza_CDR
gugggcaacgggggcaacgucgccagcaagggggac

SEQ ID NO: 14812 - RNA, 36 nt, Artificial Sequence
  derived and/or modified sequence opt1 from anti-influenza_CDR
gugcgcggcgggagcaccgucgccuacuucggcgug

SEQ ID NO: 14813 - RNA, 36 nt, Artificial Sequence
  derived and/or modified sequence opt1 from anti-influenza_CDR
ugccugagccgcaugcggggcuacgggcucgacgug

SEQ ID NO: 14814 - RNA, 36 nt, Artificial Sequence
  derived and/or modified sequence opt1 from anti-influenza_CDR
gugggccagauggacaaguacuacgccauggacguc

SEQ ID NO: 14815 - RNA, 36 nt, Artificial Sequence
  derived and/or modified sequence opt1 from anti-influenza_CDR
ggcgugaccaacaaggucaacagcaucaucgacaag

SEQ ID NO: 14816 - RNA, 36 nt, Artificial Sequence
  derived and/or modified sequence opt1 from anti-influenza_CDR
ggcgugaccaacaaggucaaccgcaucaucgacaag

SEQ ID NO: 14817 - RNA, 36 nt, Artificial Sequence
  derived and/or modified sequence opt1 from anti-influenza_CDR
ggcgugaccaacaaggagaacagcaucaucgacaag

SEQ ID NO: 14818 - RNA, 36 nt, Artificial Sequence
  derived and/or modified sequence opt1 from anti-influenza_CDR
ccccugggcauccuccacuacuacgccauggaccug

SEQ ID NO: 14819 - RNA, 36 nt, Artificial Sequence
  derived and/or modified sequence opt1 from anti-influenza_CDR
aagaucaccagcaaggugaacaacaucgucgacaag

SEQ ID NO: 14820 - RNA, 36 nt, Artificial Sequence
  derived and/or modified sequence opt1 from anti-influenza_CDR
ggcaucaccaacaaggugaacagcaucaucgacaag

SEQ ID NO: 14821 - RNA, 36 nt, Artificial Sequence
  derived and/or modified sequence opt1 from anti-influenza_CDR
aacggccgcagcuccaccagcugggggaucgacgug

SEQ ID NO: 14822 - RNA, 36 nt, Artificial Sequence
  derived and/or modified sequence opt1 from anti-influenza_CDR
ggcaucaccaacaaggagaacagcgugaucgagaag

SEQ ID NO: 14823 - RNA, 36 nt, Artificial Sequence
  derived and/or modified sequence opt1 from anti-influenza_CDR
ccccugggcagccgcuacuacuacgggauggacgug

SEQ ID NO: 14824 - RNA, 36 nt, Artificial Sequence
  derived and/or modified sequence opt1 from anti-influenza_CDR
ggcaucaccaacaaggugaacagcgucaucgagaag

SEQ ID NO: 14825 - RNA, 36 nt, Artificial Sequence
  derived and/or modified sequence opt1 from anti-influenza_CDR
ggcgugaccaacaaggucaacagcaucaucaacaag

SEQ ID NO: 14826 - RNA, 36 nt, Artificial Sequence
  derived and/or modified sequence opt1 from anti-influenza_CDR
cacaugggcuaccaggugcgcgagaccauggacguc

SEQ ID NO: 14827 - RNA, 36 nt, Artificial Sequence
  derived and/or modified sequence opt1 from anti-influenza_CDR
gccaccugggaccgccggcccaccgccuacgugguc

SEQ ID NO: 14828 - RNA, 36 nt, Artificial Sequence
  derived and/or modified sequence opt1 from anti-influenza_CDR
gagggcaagugggggccccaggccgccuucgacauc

SEQ ID NO: 14829 - RNA, 36 nt, Artificial Sequence
  derived and/or modified sequence opt1 from anti-influenza_CDR
ggcgacaaggggaucuacuacuacuacauggacgug

SEQ ID NO: 14830 - RNA, 36 nt, Artificial Sequence
  derived and/or modified sequence opt1 from anti-influenza_CDR
ggcagcggguaccacaucuccacccccuucgacaac

SEQ ID NO: 14831 - RNA, 36 nt, Artificial Sequence
  derived and/or modified sequence opt1 from anti-influenza_CDR
cgcgccagccaguccgugagcuccagcuaccuggcc

SEQ ID NO: 14832 - RNA, 36 nt, Artificial Sequence
  derived and/or modified sequence opt1 from anti-influenza_CDR
ggcagcggguacaccacccgcaacuacuucgacuac

SEQ ID NO: 14833 - RNA, 36 nt, Artificial Sequence
  derived and/or modified sequence opt1 from anti-influenza_CDR
cgcgccagccaguccgugagcuccaacuaccugggc

SEQ ID NO: 14834 - RNA, 36 nt, Artificial Sequence
  derived and/or modified sequence opt1 from anti-influenza_CDR
ggcagcaccuacgacuucuccagcgggcuggacuac

SEQ ID NO: 14835 - RNA, 36 nt, Artificial Sequence
  derived and/or modified sequence opt1 from anti-influenza_CDR
ggcgugcaccaccccgggaccgacaacgaccagauc

SEQ ID NO: 14836 - RNA, 36 nt, Artificial Sequence
  derived and/or modified sequence opt1 from anti-influenza_CDR
ggcgugcaccaccccagcaccgacuccgaccagacc

SEQ ID NO: 14837 - RNA, 36 nt, Artificial Sequence
  derived and/or modified sequence opt1 from anti-influenza_CDR
ggcgugcaccaccccagcaacgagaccgagcagcgc

SEQ ID NO: 14838 - RNA, 36 nt, Artificial Sequence
  derived and/or modified sequence opt1 from anti-influenza_CDR
cagagcaucaccuucgacuacaagaacuaccuggcc

SEQ ID NO: 14839 - RNA, 36 nt, Artificial Sequence
  derived and/or modified sequence opt1 from anti-influenza_CDR
ggcgggcugaucggcaccgggagcuacuacuggggc

SEQ ID NO: 14840 - RNA, 36 nt, Artificial Sequence
  derived and/or modified sequence opt1 from anti-influenza_CDR
gcccgcuacaacuggggcauccgguacuucgacuuc

SEQ ID NO: 14841 - RNA, 36 nt, Artificial Sequence
  derived and/or modified sequence opt1 from anti-influenza_CDR
cagagcgugcuguccaacagcaagaaccucaacuac

SEQ ID NO: 14842 - RNA, 36 nt, Artificial Sequence
  derived and/or modified sequence opt1 from anti-influenza_CDR
ugccaggugugggagaccagcgaggaccuguggguc

SEQ ID NO: 14843 - RNA, 39 nt, Artificial Sequence
  derived and/or modified sequence opt1 from anti-influenza_CDR
gcccgcggcgggcgguacuacguggacuacuucgacuac

SEQ ID NO: 14844 - RNA, 39 nt, Artificial Sequence
  derived and/or modified sequence opt1 from anti-influenza_CDR
gcccgcagcggcgacggguacaacuacuacuucccccug

SEQ ID NO: 14845 - RNA, 39 nt, Artificial Sequence
  derived and/or modified sequence opt1 from anti-influenza_CDR
gcccgcggcugcggguacaacugcuacuacuucgacggc

SEQ ID NO: 14846 - RNA, 39 nt, Artificial Sequence
  derived and/or modified sequence opt1 from anti-influenza_CDR
agcggcuccagcuccaacaucgggagcaacaccgugaac

SEQ ID NO: 14847 - RNA, 39 nt, Artificial Sequence
  derived and/or modified sequence opt1 from anti-influenza_CDR
gacagccccuacuccagcuccuggagcuucuucgacuac

SEQ ID NO: 14848 - RNA, 39 nt, Artificial Sequence
  derived and/or modified sequence opt1 from anti-influenza_CDR
agcggcuccgacagcaacaucggggacuacuucgugugc

SEQ ID NO: 14849 - RNA, 39 nt, Artificial Sequence
  derived and/or modified sequence opt1 from anti-influenza_CDR
gcccgcaugguggucgugaccggcgacggguucgacgug

SEQ ID NO: 14850 - RNA, 39 nt, Artificial Sequence
  derived and/or modified sequence opt1 from anti-influenza_CDR
uggcugagcaucaucaacgccggcgggggcgacaucgac

SEQ ID NO: 14851 - RNA, 39 nt, Artificial Sequence
  derived and/or modified sequence opt1 from anti-influenza_CDR
gccgccagcucccugcagagcggcgugcccucccgcuuc

SEQ ID NO: 14852 - RNA, 39 nt, Artificial Sequence
  derived and/or modified sequence opt1 from anti-influenza_CDR
cacgacgccaaguucagcggcuccuacuacguggccagc

SEQ ID NO: 14853 - RNA, 39 nt, Artificial Sequence
  derived and/or modified sequence opt1 from anti-influenza_CDR
cacgacgugaaguucagcggcuccuacuacgucgccagc

SEQ ID NO: 14854 - RNA, 39 nt, Artificial Sequence
  derived and/or modified sequence opt1 from anti-influenza_CDR
accggcagcgaguccaccacgggguacggcauggacgug

SEQ ID NO: 14855 - RNA, 39 nt, Artificial Sequence
  derived and/or modified sequence opt1 from anti-influenza_CDR
gccgccagcaccuccgugcugggcuacgggauggacguc

SEQ ID NO: 14856 - RNA, 39 nt, Artificial Sequence
  derived and/or modified sequence opt1 from anti-influenza_CDR
agcggcuccaccuucaacaucgggagcaacgccguggac

SEQ ID NO: 14857 - RNA, 39 nt, Artificial Sequence
  derived and/or modified sequence opt1 from anti-influenza_CDR
agcggcucccgcagcaacgugggggacaacuccgucuac

SEQ ID NO: 14858 - RNA, 39 nt, Artificial Sequence
  derived and/or modified sequence opt1 from anti-influenza_CDR
agcggcuccagcuccaacaucgggaacgacuacgugagc

SEQ ID NO: 14859 - RNA, 39 nt, Artificial Sequence
  derived and/or modified sequence opt1 from anti-influenza_CDR
ggcgggggcagcuacggggccuacgagggcuucgacuac

SEQ ID NO: 14860 - RNA, 39 nt, Artificial Sequence
  derived and/or modified sequence opt1 from anti-influenza_CDR
agcggcuccagcuccaacaucgggagcaacuacguguac

SEQ ID NO: 14861 - RNA, 39 nt, Artificial Sequence
  derived and/or modified sequence opt1 from anti-influenza_CDR
gcccgccggcagcagcuguacaagggcuacuaccaccac

SEQ ID NO: 14862 - RNA, 39 nt, Artificial Sequence
  derived and/or modified sequence opt1 from anti-influenza_CDR
agcggcuccaccagcaacaucggguacaaccccgugucc

SEQ ID NO: 14863 - RNA, 39 nt, Artificial Sequence
  derived and/or modified sequence opt1 from anti-influenza_CDR
gcccgcggcaugaacuacuacagcgacuacuucgacuac

SEQ ID NO: 14864 - RNA, 39 nt, Artificial Sequence
  derived and/or modified sequence opt1 from anti-influenza_CDR
gcccgcggccacagcggguccuaccggcuguucgacuuc

SEQ ID NO: 14865 - RNA, 39 nt, Artificial Sequence
  derived and/or modified sequence opt1 from anti-influenza_CDR
gccaagccccugcgcggcagcuaccgguacuucgaccuc

SEQ ID NO: 14866 - RNA, 39 nt, Artificial Sequence
  derived and/or modified sequence opt1 from anti-influenza_CDR
cccaucugggugaagaccccgcugaagcucgccaacggc

SEQ ID NO: 14867 - RNA, 39 nt, Artificial Sequence
  derived and/or modified sequence opt1 from anti-influenza_CDR
caggccagccaguccguguacaacaagaacaaccuggcc

SEQ ID NO: 14868 - RNA, 39 nt, Artificial Sequence
  derived and/or modified sequence opt1 from anti-influenza_CDR
cagagcuccgagagcguguacaagaacaacaaccuggcc

SEQ ID NO: 14869 - RNA, 39 nt, Artificial Sequence
  derived and/or modified sequence opt1 from anti-influenza_CDR
cagagcucccagagcguggacuccaacaaccagcugagc

SEQ ID NO: 14870 - RNA, 39 nt, Artificial Sequence
  derived and/or modified sequence opt1 from anti-influenza_CDR
cagagcucccagagcguggacaacaacaaggaccuggcc

SEQ ID NO: 14871 - RNA, 39 nt, Artificial Sequence
  derived and/or modified sequence opt1 from anti-influenza_CDR
cagagcucccagagcguguacaacaacaaccgccugucc

SEQ ID NO: 14872 - RNA, 39 nt, Artificial Sequence
  derived and/or modified sequence opt1 from anti-influenza_CDR
cagagcucccagagcguguacaagaacaacaaccuggcc

SEQ ID NO: 14873 - RNA, 39 nt, Artificial Sequence
  derived and/or modified sequence opt1 from anti-influenza_CDR
ggcgggggcuucggguggagccagaccuacuucggcuac

SEQ ID NO: 14874 - RNA, 42 nt, Artificial Sequence
  derived and/or modified sequence opt1 from anti-influenza_CDR
uggcugggccgcaccuacuaccggagcaagugguacaacgac

SEQ ID NO: 14875 - RNA, 42 nt, Artificial Sequence
  derived and/or modified sequence opt1 from anti-influenza_CDR
ggcgggcuggugggcggguacgacgaguacuucuucgacuac

SEQ ID NO: 14876 - RNA, 42 nt, Artificial Sequence
  derived and/or modified sequence opt1 from anti-influenza_CDR
caccccaaguacuucuacggcagcggguccuacccggacuuc

SEQ ID NO: 14877 - RNA, 42 nt, Artificial Sequence
  derived and/or modified sequence opt1 from anti-influenza_CDR
accggcagcuccagcgacgugggggccuccaacagcgucucc

SEQ ID NO: 14878 - RNA, 42 nt, Artificial Sequence
  derived and/or modified sequence opt1 from anti-influenza_CDR
ggcgccuacuacgacagcuccggguaccccgccuucuacauc

SEQ ID NO: 14879 - RNA, 42 nt, Artificial Sequence
  derived and/or modified sequence opt1 from anti-influenza_CDR
accggcagcuccagcaacaucggguccgacuacgacgugcac

SEQ ID NO: 14880 - RNA, 42 nt, Artificial Sequence
  derived and/or modified sequence opt1 from anti-influenza_CDR
gaguucgagaccagcggcuacuuccacggguccuucgacuac

SEQ ID NO: 14881 - RNA, 42 nt, Artificial Sequence
  derived and/or modified sequence opt1 from anti-influenza_CDR
gccagcuccaccggcgccgugaccagcuccuacuuccccaac

SEQ ID NO: 14882 - RNA, 42 nt, Artificial Sequence
  derived and/or modified sequence opt1 from anti-influenza_CDR
accggcgggagcuccgacaucggcgccagcaacuccgugagc

SEQ ID NO: 14883 - RNA, 42 nt, Artificial Sequence
  derived and/or modified sequence opt1 from anti-influenza_CDR
accggcagcuccagcgacgucgggggcuacgacuacgugucc

SEQ ID NO: 14884 - RNA, 42 nt, Artificial Sequence
  derived and/or modified sequence opt1 from anti-influenza_CDR
ggcagcuccaccggggccgugacccgcggccacuaccccuac

SEQ ID NO: 14885 - RNA, 42 nt, Artificial Sequence
  derived and/or modified sequence opt1 from anti-influenza_CDR
ggcagcuccaccgggcccgugaccagcggccacuacccguac

SEQ ID NO: 14886 - RNA, 42 nt, Artificial Sequence
  derived and/or modified sequence opt1 from anti-influenza_CDR
cacuacggcgacagcgaggccaucaacgacgccuucgacauc

SEQ ID NO: 14887 - RNA, 42 nt, Artificial Sequence
  derived and/or modified sequence opt1 from anti-influenza_CDR
accggcagcuccagcaacaucggggccggcuacgacgugcac

SEQ ID NO: 14888 - RNA, 42 nt, Artificial Sequence
  derived and/or modified sequence opt1 from anti-influenza_CDR
aucccccacuacaacuucggcagcggguccuacuucgacuac

SEQ ID NO: 14889 - RNA, 42 nt, Artificial Sequence
  derived and/or modified sequence opt1 from anti-influenza_CDR
accggcaccagcuccgacgucgggggcuacaacuacgugagc

SEQ ID NO: 14890 - RNA, 42 nt, Artificial Sequence
  derived and/or modified sequence opt1 from anti-influenza_CDR
accggcaccagcuccgacgugggggccuacaacuacgucagc

SEQ ID NO: 14891 - RNA, 42 nt, Artificial Sequence
  derived and/or modified sequence opt1 from anti-influenza_CDR
gccgagcgccccaaggugcggggccaggccgggcgcaugaac

SEQ ID NO: 14892 - RNA, 42 nt, Artificial Sequence
  derived and/or modified sequence opt1 from anti-influenza_CDR
ggcagccgccccugggugcgcggggucuccagccggaucucc

SEQ ID NO: 14893 - RNA, 42 nt, Artificial Sequence
  derived and/or modified sequence opt1 from anti-influenza_CDR
aucuggggcguggccgcccccgggaccgcggccgcccagauc

SEQ ID NO: 14894 - RNA, 42 nt, Artificial Sequence
  derived and/or modified sequence opt1 from anti-influenza_CDR
ugggugcgccagcccccgggcaaggggcuggagugggucgcc

SEQ ID NO: 14895 - RNA, 42 nt, Artificial Sequence
  derived and/or modified sequence opt1 from anti-influenza_CDR
gcccgcggccccgaggggguguggggccggagcaucgacucc

SEQ ID NO: 14896 - RNA, 42 nt, Artificial Sequence
  derived and/or modified sequence opt1 from anti-influenza_CDR
gcccgcgaccccgacaccccguucgugcgggccuucgacagc

SEQ ID NO: 14897 - RNA, 42 nt, Artificial Sequence
  derived and/or modified sequence opt1 from anti-influenza_CDR
accggcagcaccuccgacaucgggagcuacaacuacgugucc

SEQ ID NO: 14898 - RNA, 42 nt, Artificial Sequence
  derived and/or modified sequence opt1 from anti-influenza_CDR
ugggacuggaacuucgaccuguaccucggcugguucgacccc

SEQ ID NO: 14899 - RNA, 42 nt, Artificial Sequence
  derived and/or modified sequence opt1 from anti-influenza_CDR
ugggccuggaacuucgacuucuuccugggcugguucgacccc

SEQ ID NO: 14900 - RNA, 42 nt, Artificial Sequence
  derived and/or modified sequence opt1 from anti-influenza_CDR
ggccccggguacagcggcuaccacuacgggugguucgacacc

SEQ ID NO: 14901 - RNA, 42 nt, Artificial Sequence
  derived and/or modified sequence opt1 from anti-influenza_CDR
gcccgcugggacuacggcguguacgagggguacaucgacuac

SEQ ID NO: 14902 - RNA, 45 nt, Artificial Sequence
  derived and/or modified sequence opt1 from anti-influenza_CDR
gcccgcgccggcaccacccugacgcgguucaacugguucgacccc

SEQ ID NO: 14903 - RNA, 45 nt, Artificial Sequence
  derived and/or modified sequence opt1 from anti-influenza_CDR
gcccgcgccggcaccaccgugacgcgguucaacugguucgacccc

SEQ ID NO: 14904 - RNA, 45 nt, Artificial Sequence
  derived and/or modified sequence opt1 from anti-influenza_CDR
gcccgcggccagcgguacuacuacgaccgcgacgggauggacgug

SEQ ID NO: 14905 - RNA, 45 nt, Artificial Sequence
  derived and/or modified sequence opt1 from anti-influenza_CDR
gcccgcagcggcggguaccugccccagaacaacuggaucgacccg

SEQ ID NO: 14906 - RNA, 45 nt, Artificial Sequence
  derived and/or modified sequence opt1 from anti-influenza_CDR
auggagaacgagcgcacccuggacuuccacgacagcaacgugaag

SEQ ID NO: 14907 - RNA, 45 nt, Artificial Sequence
  derived and/or modified sequence opt1 from anti-influenza_CDR
ggcgccgaccacgggagcggcuccaacuucgugagccccuacguc

SEQ ID NO: 14908 - RNA, 45 nt, Artificial Sequence
  derived and/or modified sequence opt1 from anti-influenza_CDR
gacacccgcagcucccuggacaacuaccaguacggcauggacgug

SEQ ID NO: 14909 - RNA, 45 nt, Artificial Sequence
  derived and/or modified sequence opt1 from anti-influenza_CDR
gaggacuacgacauccugaccggcgccgggcccggcauggaggug

SEQ ID NO: 14910 - RNA, 45 nt, Artificial Sequence
  derived and/or modified sequence opt1 from anti-influenza_CDR
caccccuacgacgugcugaccggcagcggggacugguucgacccg

SEQ ID NO: 14911 - RNA, 45 nt, Artificial Sequence
  derived and/or modified sequence opt1 from anti-influenza_CDR
ggcgccgaccacgggagcggcaacaacuucgugucccccuacguc

SEQ ID NO: 14912 - RNA, 45 nt, Artificial Sequence
  derived and/or modified sequence opt1 from anti-influenza_CDR
gugaucuacagcggcggguccaccuacuacgccgacagcgucaag

SEQ ID NO: 14913 - RNA, 45 nt, Artificial Sequence
  derived and/or modified sequence opt1 from anti-influenza_CDR
ugguaccagcagaagcccggcaaggccccgaagcugcucaucuac

SEQ ID NO: 14914 - RNA, 45 nt, Artificial Sequence
  derived and/or modified sequence opt1 from anti-influenza_CDR
gaccccuacaacgacggcaccaaguacaacgagaaguucgagggg

SEQ ID NO: 14915 - RNA, 45 nt, Artificial Sequence
  derived and/or modified sequence opt1 from anti-influenza_CDR
gcccgcgcccacaccgcgcugacccgguuccgcuggcucgacccc

SEQ ID NO: 14916 - RNA, 45 nt, Artificial Sequence
  derived and/or modified sequence opt1 from anti-influenza_CDR
gccagccuggacuacgacuucuccuacuacuaccaccgcgacgug

SEQ ID NO: 14917 - RNA, 45 nt, Artificial Sequence
  derived and/or modified sequence opt1 from anti-influenza_CDR
gcccgcguggccacccccuacuacuacgagagcggcuucgacuac

SEQ ID NO: 14918 - RNA, 45 nt, Artificial Sequence
  derived and/or modified sequence opt1 from anti-influenza_CDR
gcccgccggggcgggggcuggcaguacuacuacgggauggacgug

SEQ ID NO: 14919 - RNA, 48 nt, Artificial Sequence
  derived and/or modified sequence opt1 from anti-influenza_CDR
agcggccacaucaccguguucggggucaacguggacgccuucgacaug

SEQ ID NO: 14920 - RNA, 48 nt, Artificial Sequence
  derived and/or modified sequence opt1 from anti-influenza_CDR
ggcgggcacaucaccguguucggccugaacaucgacgccuacgacauc

SEQ ID NO: 14921 - RNA, 48 nt, Artificial Sequence
  derived and/or modified sequence opt1 from anti-influenza_CDR
ggcgggcacaucaccgaguucggccugaacaucgacgccuacgacauc

SEQ ID NO: 14922 - RNA, 48 nt, Artificial Sequence
  derived and/or modified sequence opt1 from anti-influenza_CDR
ggcgggcacaucaccguguucggcgucaacaucgacgccuucgacauc

SEQ ID NO: 14923 - RNA, 48 nt, Artificial Sequence
  derived and/or modified sequence opt1 from anti-influenza_CDR
ggcgggcacaucaccguguucggcgucaacaucgacgccuucgacgug

SEQ ID NO: 14924 - RNA, 48 nt, Artificial Sequence
  derived and/or modified sequence opt1 from anti-influenza_CDR
gcccgcgacggcugggggcagcagcuggugcccuacuacuucgacuac

SEQ ID NO: 14925 - RNA, 48 nt, Artificial Sequence
  derived and/or modified sequence opt1 from anti-influenza_CDR
gacuucugggugagcuacuacuacgacuccagcgccccgcccgccauc

SEQ ID NO: 14926 - RNA, 48 nt, Artificial Sequence
  derived and/or modified sequence opt1 from anti-influenza_CDR
gcccgcgccggcgugaagaucuucgggcugaucgucggcgcgcucgac

SEQ ID NO: 14927 - RNA, 48 nt, Artificial Sequence
  derived and/or modified sequence opt1 from anti-influenza_CDR
gcccgcgacggcgccgggagcuacuacccccugaacugguucgacccg

SEQ ID NO: 14928 - RNA, 48 nt, Artificial Sequence
  derived and/or modified sequence opt1 from anti-influenza_CDR
gugaucuacagccacggccgcgccuacuacuccgccagcgucaacggg

SEQ ID NO: 14929 - RNA, 48 nt, Artificial Sequence
  derived and/or modified sequence opt1 from anti-influenza_CDR
gacacccugcacaacggcuacaccaacuacaaccccagccuccgcggg

SEQ ID NO: 14930 - RNA, 48 nt, Artificial Sequence
  derived and/or modified sequence opt1 from anti-influenza_CDR
uacaucagcuacaacggccgccccaaguacaacccgucccugaccagc

SEQ ID NO: 14931 - RNA, 48 nt, Artificial Sequence
  derived and/or modified sequence opt1 from anti-influenza_CDR
gagacccgcuucggcgagcugcucagccccuacgacgccuucgagauc

SEQ ID NO: 14932 - RNA, 48 nt, Artificial Sequence
  derived and/or modified sequence opt1 from anti-influenza_CDR
cugaucuacugggacgacgacaagcgcuacagccccucccucaagcgg

SEQ ID NO: 14933 - RNA, 48 nt, Artificial Sequence
  derived and/or modified sequence opt1 from anti-influenza_CDR
uacaucuacuacaucggcaacaccgacuaccgccccagccugaagucc

SEQ ID NO: 14934 - RNA, 48 nt, Artificial Sequence
  derived and/or modified sequence opt1 from anti-influenza_CDR
gagaucagccacggcggguccaccaacuacaaccccagccugaagucc

SEQ ID NO: 14935 - RNA, 48 nt, Artificial Sequence
  derived and/or modified sequence opt1 from anti-influenza_CDR
gagaucaaccacagcggccgcaccaacuacaaccccagccugaagucc

SEQ ID NO: 14936 - RNA, 48 nt, Artificial Sequence
  derived and/or modified sequence opt1 from anti-influenza_CDR
cugaucagcugggacgacgagaagcacuacucccccagccuccagucc

SEQ ID NO: 14937 - RNA, 48 nt, Artificial Sequence
  derived and/or modified sequence opt1 from anti-influenza_CDR
gagggcguguacuucgacagcgggaccuaccgcggcuacuucgacuac

SEQ ID NO: 14938 - RNA, 48 nt, Artificial Sequence
  derived and/or modified sequence opt1 from anti-influenza_CDR
uacaucuaccacagcggcuccaccaacuacaaccccagccugaagucc

SEQ ID NO: 14939 - RNA, 48 nt, Artificial Sequence
  derived and/or modified sequence opt1 from anti-influenza_CDR
uacaucuacuaccgcggcagcaccuucuacaaccccagccugaagucc

SEQ ID NO: 14940 - RNA, 48 nt, Artificial Sequence
  derived and/or modified sequence opt1 from anti-influenza_CDR
uacaucagcuacuccggcagcaccaaguacaaccccucccugcgcagc

SEQ ID NO: 14941 - RNA, 48 nt, Artificial Sequence
  derived and/or modified sequence opt1 from anti-influenza_CDR
gagaucaagcacagcggccgcaccaacuacaaccccucccuggagagc

SEQ ID NO: 14942 - RNA, 48 nt, Artificial Sequence
  derived and/or modified sequence opt1 from anti-influenza_CDR
gagaucaaccacagcggcgggaccaacuacaaccccucccugaagcgc

SEQ ID NO: 14943 - RNA, 48 nt, Artificial Sequence
  derived and/or modified sequence opt1 from anti-influenza_CDR
uucauguacuacagcgccuccaccuacuacaaccccagccugaagucc

SEQ ID NO: 14944 - RNA, 48 nt, Artificial Sequence
  derived and/or modified sequence opt1 from anti-influenza_CDR
uacguguacuacagcggcuccaccaccuacaaccccagccugaagucc

SEQ ID NO: 14945 - RNA, 48 nt, Artificial Sequence
  derived and/or modified sequence opt1 from anti-influenza_CDR
aacaucuacuacaccggcaucaccuucuacaaccccagccuguccagc

SEQ ID NO: 14946 - RNA, 48 nt, Artificial Sequence
  derived and/or modified sequence opt1 from anti-influenza_CDR
uucaucuacuacggcgggaacaccaaguacaaccccagccugaagucc

SEQ ID NO: 14947 - RNA, 48 nt, Artificial Sequence
  derived and/or modified sequence opt1 from anti-influenza_CDR
uucauguuccacagcggcagcccccgcuacaacccgacccugaagucc

SEQ ID NO: 14948 - RNA, 48 nt, Artificial Sequence
  derived and/or modified sequence opt1 from anti-influenza_CDR
uucuucuacaacggcgggagcaccaaguacaaccccagccugaagucc

SEQ ID NO: 14949 - RNA, 48 nt, Artificial Sequence
  derived and/or modified sequence opt1 from anti-influenza_CDR
cacaucuacgacuacggccgcaccuucuacaacagcucccugcagagc

SEQ ID NO: 14950 - RNA, 48 nt, Artificial Sequence
  derived and/or modified sequence opt1 from anti-influenza_CDR
guguucuacagcgagacccgcaccuacuacgccgacuccgucaagggc

SEQ ID NO: 14951 - RNA, 48 nt, Artificial Sequence
  derived and/or modified sequence opt1 from anti-influenza_CDR
uacguguacaaccgcggcagcaccaaguacucccccagccugaagucc

SEQ ID NO: 14952 - RNA, 48 nt, Artificial Sequence
  derived and/or modified sequence opt1 from anti-influenza_CDR
uacaucuacaaccgcggcagcaccaaguacacccccagccugaagucc

SEQ ID NO: 14953 - RNA, 48 nt, Artificial Sequence
  derived and/or modified sequence opt1 from anti-influenza_CDR
uaccuguacuacagcggcuccaccaaguacaaccccagccucaagucc

SEQ ID NO: 14954 - RNA, 48 nt, Artificial Sequence
  derived and/or modified sequence opt1 from anti-influenza_CDR
uacguguacaacagcggcaacaccaaguacaaccccagccugaagucc

SEQ ID NO: 14955 - RNA, 48 nt, Artificial Sequence
  derived and/or modified sequence opt1 from anti-influenza_CDR
cacaucuucgacagcggcuccaccuacuacaaccccagccugaagucc

SEQ ID NO: 14956 - RNA, 48 nt, Artificial Sequence
  derived and/or modified sequence opt1 from anti-influenza_CDR
guguucuacagcgccgaccgcaccuccuacgccgacagcgucaagggc

SEQ ID NO: 14957 - RNA, 48 nt, Artificial Sequence
  derived and/or modified sequence opt1 from anti-influenza_CDR
uacaucuacuacagcggcaacaccuacuacaaccccagccugaagucc

SEQ ID NO: 14958 - RNA, 48 nt, Artificial Sequence
  derived and/or modified sequence opt1 from anti-influenza_CDR
cgcagcucccagagccugcuccacuccaacggcuacaacuaccuggac

SEQ ID NO: 14959 - RNA, 48 nt, Artificial Sequence
  derived and/or modified sequence opt1 from anti-influenza_CDR
accaucuaccacagcggcuccaccuacuacaaccccagccugaagucc

SEQ ID NO: 14960 - RNA, 48 nt, Artificial Sequence
  derived and/or modified sequence opt1 from anti-influenza_CDR
cgcagcucccagagccugcuccacuccaacggccacaucuacuucgac

SEQ ID NO: 14961 - RNA, 48 nt, Artificial Sequence
  derived and/or modified sequence opt1 from anti-influenza_CDR
aucuggggcguggccgcccccagcaccgcguccgcccagaccagccug

SEQ ID NO: 14962 - RNA, 48 nt, Artificial Sequence
  derived and/or modified sequence opt1 from anti-influenza_CDR
cgcagcucccagagccugcucuacaccgacggcuucaccuaccugucc

SEQ ID NO: 14963 - RNA, 48 nt, Artificial Sequence
  derived and/or modified sequence opt1 from anti-influenza_CDR
gccaagccccgccuggacuaccucgacuacuuccacgccgcggacagc

SEQ ID NO: 14964 - RNA, 48 nt, Artificial Sequence
  derived and/or modified sequence opt1 from anti-influenza_CDR
gcccgcagccccggcuacuccggguaccuguacggcugguucgacccg

SEQ ID NO: 14965 - RNA, 48 nt, Artificial Sequence
  derived and/or modified sequence opt1 from anti-influenza_CDR
gccaucgccggcagcggguccgcggacuacgccagcugggccaagggc

SEQ ID NO: 14966 - RNA, 48 nt, Artificial Sequence
  derived and/or modified sequence opt1 from anti-influenza_CDR
gccaucgccggcagcggguccgcggacuacgccagcugggccaagucc

SEQ ID NO: 14967 - RNA, 48 nt, Artificial Sequence
  derived and/or modified sequence opt1 from anti-influenza_CDR
gccaucggcgggggcgggagcgccgacuacgcguccugggccaagagc

SEQ ID NO: 14968 - RNA, 48 nt, Artificial Sequence
  derived and/or modified sequence opt1 from anti-influenza_CDR
cgcagcucccagagccugcuccgguccaacggcuacaacuaccuggac

SEQ ID NO: 14969 - RNA, 48 nt, Artificial Sequence
  derived and/or modified sequence opt1 from anti-influenza_CDR
cagggcgaccacaucgccuggcugcuccgcgggaucaacuucgacuac

SEQ ID NO: 14970 - RNA, 51 nt, Artificial Sequence
  derived and/or modified sequence opt1 from anti-influenza_CDR
gcccgccugggcagcggguccuaccacaacggccccaacugguucgacccg

SEQ ID NO: 14971 - RNA, 51 nt, Artificial Sequence
  derived and/or modified sequence opt1 from anti-influenza_CDR
gcccgcgccgagaaccugcucagccccuaccuggcggagggcuucgacccg

SEQ ID NO: 14972 - RNA, 51 nt, Artificial Sequence
  derived and/or modified sequence opt1 from anti-influenza_CDR
gugaucagcuacgacggcuccaacaaguacuacgccgacagcgucaagggg

SEQ ID NO: 14973 - RNA, 51 nt, Artificial Sequence
  derived and/or modified sequence opt1 from anti-influenza_CDR
ggcaccaucccccugcucgggaccacgaacuacgcccagaaguuccagggc

SEQ ID NO: 14974 - RNA, 51 nt, Artificial Sequence
  derived and/or modified sequence opt1 from anti-influenza_CDR
ggcaucaucgccguguucaacaccgccaacuacgcgcagaaguuccagggg

SEQ ID NO: 14975 - RNA, 51 nt, Artificial Sequence
  derived and/or modified sequence opt1 from anti-influenza_CDR
aacaucgaggacgacggcggggacaaguacuacguggacagcgucaagggc

SEQ ID NO: 14976 - RNA, 51 nt, Artificial Sequence
  derived and/or modified sequence opt1 from anti-influenza_CDR
uggaucaaccccaacagcggcaccaccggguccgcccagcgcuuccagggc

SEQ ID NO: 14977 - RNA, 51 nt, Artificial Sequence
  derived and/or modified sequence opt1 from anti-influenza_CDR
ggcaucaaccccguguucgggcgcccgcacuacgcccagaaguuccagggc

SEQ ID NO: 14978 - RNA, 51 nt, Artificial Sequence
  derived and/or modified sequence opt1 from anti-influenza_CDR
ggcaucaucccccugaucaacgccccgaacuacgcccccaaguuccagggg

SEQ ID NO: 14979 - RNA, 51 nt, Artificial Sequence
  derived and/or modified sequence opt1 from anti-influenza_CDR
ggcaucauccccaugauggggaccgugaacuacgcccagaagcugcagggc

SEQ ID NO: 14980 - RNA, 51 nt, Artificial Sequence
  derived and/or modified sequence opt1 from anti-influenza_CDR
ggcaucaucccccuguucggggccgccaaguacgcgcagaaguuccagggc

SEQ ID NO: 14981 - RNA, 51 nt, Artificial Sequence
  derived and/or modified sequence opt1 from anti-influenza_CDR
aagagcucccagcgcgugcuguacagcuccaacaacaagaacuaccucgcc

SEQ ID NO: 14982 - RNA, 51 nt, Artificial Sequence
  derived and/or modified sequence opt1 from anti-influenza_CDR
cugaucagcgacgacggcuccaacaaguucuacgccgacagcgugaagggg

SEQ ID NO: 14983 - RNA, 51 nt, Artificial Sequence
  derived and/or modified sequence opt1 from anti-influenza_CDR
aucaucagcuacgacggcaacgaccaguacuacaccgacuccgugaagggg

SEQ ID NO: 14984 - RNA, 51 nt, Artificial Sequence
  derived and/or modified sequence opt1 from anti-influenza_CDR
uggaucagcaccuacaacggcaacaccaacuucgcccagaacuuccagggg

SEQ ID NO: 14985 - RNA, 51 nt, Artificial Sequence
  derived and/or modified sequence opt1 from anti-influenza_CDR
guggagggcagcuaccgcgacuucuggaacaaccagaaccgguucgacccc

SEQ ID NO: 14986 - RNA, 51 nt, Artificial Sequence
  derived and/or modified sequence opt1 from anti-influenza_CDR
uggaucaaccccaacagcggcgacaccaacuacgcccagaaguuccagggg

SEQ ID NO: 14987 - RNA, 51 nt, Artificial Sequence
  derived and/or modified sequence opt1 from anti-influenza_CDR
aagagcucccagagcgugcuguacuccagcaacaacaagucccaccucgcc

SEQ ID NO: 14988 - RNA, 51 nt, Artificial Sequence
  derived and/or modified sequence opt1 from anti-influenza_CDR
aucaucuaccccggcgacagcgacacccgcuacuccccgagcuuccagggg

SEQ ID NO: 14989 - RNA, 51 nt, Artificial Sequence
  derived and/or modified sequence opt1 from anti-influenza_CDR
ggcaucauccccguguucccgacccccaacuacgcccagauguuccagggg

SEQ ID NO: 14990 - RNA, 51 nt, Artificial Sequence
  derived and/or modified sequence opt1 from anti-influenza_CDR
ggcaucgugcccgucuucgggaccgccaacuacgcccagaaguuccagggc

SEQ ID NO: 14991 - RNA, 51 nt, Artificial Sequence
  derived and/or modified sequence opt1 from anti-influenza_CDR
uggaucaaccccgagagcggcgacaccaaguacgcccagaaguuccagggg

SEQ ID NO: 14992 - RNA, 51 nt, Artificial Sequence
  derived and/or modified sequence opt1 from anti-influenza_CDR
cgcagcucccagagcaucuuccacaacuccaacaacgagaacuaccuggcc

SEQ ID NO: 14993 - RNA, 51 nt, Artificial Sequence
  derived and/or modified sequence opt1 from anti-influenza_CDR
uggaucaacgccaagcgcggcgggaccaacuacgcccagaaguuccagggc

SEQ ID NO: 14994 - RNA, 51 nt, Artificial Sequence
  derived and/or modified sequence opt1 from anti-influenza_CDR
uggaucaaccccgacagcggcgccaccuccagcgcccagaacuuccagggg

SEQ ID NO: 14995 - RNA, 51 nt, Artificial Sequence
  derived and/or modified sequence opt1 from anti-influenza_CDR
uggaucagccccgacuccgacgccaccaaguacgcccagaaguuccagggc

SEQ ID NO: 14996 - RNA, 51 nt, Artificial Sequence
  derived and/or modified sequence opt1 from anti-influenza_CDR
aacaucaagcaggacggccgcgagaaguacuacguggacagccugcggggg

SEQ ID NO: 14997 - RNA, 51 nt, Artificial Sequence
  derived and/or modified sequence opt1 from anti-influenza_CDR
ggcaucaucgccaucuucgggacccccaaguacgcccagaaguuccagggc

SEQ ID NO: 14998 - RNA, 51 nt, Artificial Sequence
  derived and/or modified sequence opt1 from anti-influenza_CDR
aagagcucccagagcauccugaacuccagcaacaacaagaacuaccucgcc

SEQ ID NO: 14999 - RNA, 51 nt, Artificial Sequence
  derived and/or modified sequence opt1 from anti-influenza_CDR
uggaucagcgccuacaacggcaacaccaacuacgcccagaaguuccagggg

SEQ ID NO: 15000 - RNA, 51 nt, Artificial Sequence
  derived and/or modified sequence opt1 from anti-influenza_CDR
ggcgugauccccaucuuccgcaccgccaacuacgcccagaacuuccagggg

SEQ ID NO: 15001 - RNA, 51 nt, Artificial Sequence
  derived and/or modified sequence opt1 from anti-influenza_CDR
ggcaucaucgccaucuuccacacccccaaguacgcccagaaguuccagggg

SEQ ID NO: 15002 - RNA, 51 nt, Artificial Sequence
  derived and/or modified sequence opt1 from anti-influenza_CDR
ggcaucagccccauguucgggaccaccacguacgcccagaaguuccagggc

SEQ ID NO: 15003 - RNA, 51 nt, Artificial Sequence
  derived and/or modified sequence opt1 from anti-influenza_CDR
aagagcucccagagcgugcuguacuccagcaacaacaagaacuaccucgcc

SEQ ID NO: 15004 - RNA, 51 nt, Artificial Sequence
  derived and/or modified sequence opt1 from anti-influenza_CDR
ggcaucauccccaucuucgggaccaccaaguacgccccgaaguuccagggc

SEQ ID NO: 15005 - RNA, 51 nt, Artificial Sequence
  derived and/or modified sequence opt1 from anti-influenza_CDR
ggcaucagcccccuguucgggaccaccaacuacgcccagaaguuccagggc

SEQ ID NO: 15006 - RNA, 51 nt, Artificial Sequence
  derived and/or modified sequence opt1 from anti-influenza_CDR
ggcaucauggggauguucggcaccaccaacuacgcccagaaguuccagggg

SEQ ID NO: 15007 - RNA, 51 nt, Artificial Sequence
  derived and/or modified sequence opt1 from anti-influenza_CDR
ggcaucaucgggauguucggcagcaccaacuacgcccagaacuuccagggg

SEQ ID NO: 15008 - RNA, 51 nt, Artificial Sequence
  derived and/or modified sequence opt1 from anti-influenza_CDR
uggaucaaccccaacagcggcgggaccaacuacgcccagaaguuccagggc

SEQ ID NO: 15009 - RNA, 51 nt, Artificial Sequence
  derived and/or modified sequence opt1 from anti-influenza_CDR
gccaucagcuccagcggcgacuccaccuacuacgccgacagcgugaagggg

SEQ ID NO: 15010 - RNA, 51 nt, Artificial Sequence
  derived and/or modified sequence opt1 from anti-influenza_CDR
agcaucuccagcuccagcuccuacaucuacuacguggacagcgucaagggc

SEQ ID NO: 15011 - RNA, 51 nt, Artificial Sequence
  derived and/or modified sequence opt1 from anti-influenza_CDR
gacaucaucggcauguucgggagcaccaacuacgcccagaacuuccagggc

SEQ ID NO: 15012 - RNA, 51 nt, Artificial Sequence
  derived and/or modified sequence opt1 from anti-influenza_CDR
ggcaucauccccauguucgggaccaccaacuacgcccagaaguuccagggc

SEQ ID NO: 15013 - RNA, 51 nt, Artificial Sequence
  derived and/or modified sequence opt1 from anti-influenza_CDR
ggcaucaucgccaucuucgggaccgccaacuacgcgcagaaguuccagggc

SEQ ID NO: 15014 - RNA, 51 nt, Artificial Sequence
  derived and/or modified sequence opt1 from anti-influenza_CDR
ggcaucauccccaucuucgggaccaccaacuacgcccagaaguuccagggc

SEQ ID NO: 15015 - RNA, 51 nt, Artificial Sequence
  derived and/or modified sequence opt1 from anti-influenza_CDR
ggcaucuucgcccuguucgggaccaccgacuacgcccagaaguuccagggc

SEQ ID NO: 15016 - RNA, 51 nt, Artificial Sequence
  derived and/or modified sequence opt1 from anti-influenza_CDR
ggcaucaucgggauguucggcaccgccaacuacgcccagaaguuccagggg

SEQ ID NO: 15017 - RNA, 51 nt, Artificial Sequence
  derived and/or modified sequence opt1 from anti-influenza_CDR
ggcaucaucgccguguucgggaccaccaaguacgcccacaaguuccagggc

SEQ ID NO: 15018 - RNA, 51 nt, Artificial Sequence
  derived and/or modified sequence opt1 from anti-influenza_CDR
ggcauccuggggguguucggcagccccuccuacgcccagaaguuccagggg

SEQ ID NO: 15019 - RNA, 51 nt, Artificial Sequence
  derived and/or modified sequence opt1 from anti-influenza_CDR
ggcaucuucgggauguucggcaccgccaacuacgcccagaaguuccagggg

SEQ ID NO: 15020 - RNA, 51 nt, Artificial Sequence
  derived and/or modified sequence opt1 from anti-influenza_CDR
uggaucagcgccuacaccggcgacaccgacuacgcccagaaguuccagggg

SEQ ID NO: 15021 - RNA, 51 nt, Artificial Sequence
  derived and/or modified sequence opt1 from anti-influenza_CDR
agcuucgaccccgaggacggcgagaccaucuacgcccagaaguuccagggg

SEQ ID NO: 15022 - RNA, 51 nt, Artificial Sequence
  derived and/or modified sequence opt1 from anti-influenza_CDR
ggcaucagcggguccggcgagagcaccuacuacgccgacuccgugaagggg

SEQ ID NO: 15023 - RNA, 51 nt, Artificial Sequence
  derived and/or modified sequence opt1 from anti-influenza_CDR
guggucagcuacgacggcaacuacaaguacuacgccgacuccgugcagggg

SEQ ID NO: 15024 - RNA, 51 nt, Artificial Sequence
  derived and/or modified sequence opt1 from anti-influenza_CDR
ggcagcaucuccuacagcggguccaccuacuaccaccccagccugaagucc

SEQ ID NO: 15025 - RNA, 51 nt, Artificial Sequence
  derived and/or modified sequence opt1 from anti-influenza_CDR
acccgcggccggcccaucgggcgcaacugggagccgcgggacaaggacuac

SEQ ID NO: 15026 - RNA, 51 nt, Artificial Sequence
  derived and/or modified sequence opt1 from anti-influenza_CDR
gcccgcgaggccggcuaccacagcuccuucagcgggguguacuucgacuac

SEQ ID NO: 15027 - RNA, 51 nt, Artificial Sequence
  derived and/or modified sequence opt1 from anti-influenza_CDR
cgcaucgaccccaacggcagcgggaccaccuacgcccagaaguuccagggc

SEQ ID NO: 15028 - RNA, 51 nt, Artificial Sequence
  derived and/or modified sequence opt1 from anti-influenza_CDR
cgcaucgaccccaacggcgccgggaccaccuacgcccagaaguuccagggc

SEQ ID NO: 15029 - RNA, 51 nt, Artificial Sequence
  derived and/or modified sequence opt1 from anti-influenza_CDR
uggaucgaccccaacaacgacggcaccaucuacgcccagaaguuccagggg

SEQ ID NO: 15030 - RNA, 51 nt, Artificial Sequence
  derived and/or modified sequence opt1 from anti-influenza_CDR
augauguaccccggcgacagcgacaccaucuacuccccgagcuuccagggg

SEQ ID NO: 15031 - RNA, 51 nt, Artificial Sequence
  derived and/or modified sequence opt1 from anti-influenza_CDR
augauguaccccggcgacgccgacgccaucuacagcccguccuuccagggg

SEQ ID NO: 15032 - RNA, 51 nt, Artificial Sequence
  derived and/or modified sequence opt1 from anti-influenza_CDR
augauguaccccggcgagagcgagaccaucuacuccccgagcuuccagggg

SEQ ID NO: 15033 - RNA, 51 nt, Artificial Sequence
  derived and/or modified sequence opt1 from anti-influenza_CDR
augauguaccccggcgacgccgacaccaucuacagcccguccuuccagggg

SEQ ID NO: 15034 - RNA, 51 nt, Artificial Sequence
  derived and/or modified sequence opt1 from anti-influenza_CDR
augauguaccccggcagcuccgacaccaucuacagcccguccuuccagggg

SEQ ID NO: 15035 - RNA, 51 nt, Artificial Sequence
  derived and/or modified sequence opt1 from anti-influenza_CDR
augauguaccccggcgacagcgacgccaucuacuccccgagcuuccagggg

SEQ ID NO: 15036 - RNA, 51 nt, Artificial Sequence
  derived and/or modified sequence opt1 from anti-influenza_CDR
augauguaccccggcgacaccgacaccaucuacagcccguccuuccagggg

SEQ ID NO: 15037 - RNA, 51 nt, Artificial Sequence
  derived and/or modified sequence opt1 from anti-influenza_CDR
augauguaccccggcgagagcgacaccaucuacuccccgagcuuccagggg

SEQ ID NO: 15038 - RNA, 51 nt, Artificial Sequence
  derived and/or modified sequence opt1 from anti-influenza_CDR
gugaucagcugggacuccggccgcaucggguacgccgacagcgucaagggc

SEQ ID NO: 15039 - RNA, 51 nt, Artificial Sequence
  derived and/or modified sequence opt1 from anti-influenza_CDR
gugcgcagcggcgccuacuacuucaacuaccugguccccuacuucgacuac

SEQ ID NO: 15040 - RNA, 51 nt, Artificial Sequence
  derived and/or modified sequence opt1 from anti-influenza_CDR
gugcgcagcggcgccuacuacgucaacuaccuggugcccuacuucgacuac

SEQ ID NO: 15041 - RNA, 51 nt, Artificial Sequence
  derived and/or modified sequence opt1 from anti-influenza_CDR
aucaucagcugggacuccggccgcaucggguacgccgacagcgugcggggc

SEQ ID NO: 15042 - RNA, 51 nt, Artificial Sequence
  derived and/or modified sequence opt1 from anti-influenza_CDR
cacggcgggguguacuacuacggcagcgccuccagcgggugguucgacccc

SEQ ID NO: 15043 - RNA, 54 nt, Artificial Sequence
  derived and/or modified sequence opt1 from anti-influenza_CDR
cgcaccuacuaccggagcaagugguacaacgacuacgccgagagcgugaagucc

SEQ ID NO: 15044 - RNA, 54 nt, Artificial Sequence
  derived and/or modified sequence opt1 from anti-influenza_CDR
cgcaccuacuaccggagcaagugguacuacgacuacgccgagagcgugaagucc

SEQ ID NO: 15045 - RNA, 54 nt, Artificial Sequence
  derived and/or modified sequence opt1 from anti-influenza_CDR
cgcaccuacuaccggagcaagugguacaacgacuacgccguguccgucaagagc

SEQ ID NO: 15046 - RNA, 54 nt, Artificial Sequence
  derived and/or modified sequence opt1 from anti-influenza_CDR
cgcaccuacuaccggagcaagugguacaacgacuacgccgacuuccugaagcgc

SEQ ID NO: 15047 - RNA, 54 nt, Artificial Sequence
  derived and/or modified sequence opt1 from anti-influenza_CDR
cgcaccuacuaccggagcggcugguacaacgacuacgccgagagcgugaagucc

SEQ ID NO: 15048 - RNA, 54 nt, Artificial Sequence
  derived and/or modified sequence opt1 from anti-influenza_CDR
gcccgccugggcgggaacaaggacuacggcgacuaccucugguacuucgaccug

SEQ ID NO: 15049 - RNA, 54 nt, Artificial Sequence
  derived and/or modified sequence opt1 from anti-influenza_CDR
gccaaggacaccgccgaccacggcgacuacguggaccugggguucuucgacgcg

SEQ ID NO: 15050 - RNA, 54 nt, Artificial Sequence
  derived and/or modified sequence opt1 from anti-influenza_CDR
gcccgcagcggcaucuucgacugguccgcgccccugguggaggccuucgacauc

SEQ ID NO: 15051 - RNA, 54 nt, Artificial Sequence
  derived and/or modified sequence opt1 from anti-influenza_CDR
gcccgccacgccagcugcuccgcgcggagcugcuacuggggccccguggacuac

SEQ ID NO: 15052 - RNA, 54 nt, Artificial Sequence
  derived and/or modified sequence opt1 from anti-influenza_CDR
gacgccccgcccaacguggaggucgccagcaugaccaacugguacuucgaccug

SEQ ID NO: 15053 - RNA, 54 nt, Artificial Sequence
  derived and/or modified sequence opt1 from anti-influenza_CDR
cugcgcaccgacuacggcgaccccgacagcguguacuacuacgggauggacguc

SEQ ID NO: 15054 - RNA, 54 nt, Artificial Sequence
  derived and/or modified sequence opt1 from anti-influenza_CDR
gggaccugcgccggcgacugcagccugcacuacuacuacuacggccucgacgug

SEQ ID NO: 15055 - RNA, 54 nt, Artificial Sequence
  derived and/or modified sequence opt1 from anti-influenza_CDR
cacgugagcgucucccacggcgggcgcaccaagagcaaccccuccgugaugagc

SEQ ID NO: 15056 - RNA, 54 nt, Artificial Sequence
  derived and/or modified sequence opt1 from anti-influenza_CDR
gcccugaucuacuucgacggcagcaagcaguacuacgccgacuccgugaagggg

SEQ ID NO: 15057 - RNA, 54 nt, Artificial Sequence
  derived and/or modified sequence opt1 from anti-influenza_CDR
acccugaucagcuacgacggcgccaaccaguacuacgccgacuccgugaagggg

SEQ ID NO: 15058 - RNA, 54 nt, Artificial Sequence
  derived and/or modified sequence opt1 from anti-influenza_CDR
gccgugcccggccccgucuucgggaucuucccgcccuggagcuacuucgacaac

SEQ ID NO: 15059 - RNA, 54 nt, Artificial Sequence
  derived and/or modified sequence opt1 from anti-influenza_CDR
ggcgggaucauccccaucuucggcgccgccaacuacgcgcagaaguuccagggg

SEQ ID NO: 15060 - RNA, 54 nt, Artificial Sequence
  derived and/or modified sequence opt1 from anti-influenza_CDR
ggcuggaucagcgccuacaccgggaacacccacuacgccaagaacuucgagggc

SEQ ID NO: 15061 - RNA, 54 nt, Artificial Sequence
  derived and/or modified sequence opt1 from anti-influenza_CDR
ggcuggaucaaccccaacuucgggggcacccacuacgcccgcaaguuccagggg

SEQ ID NO: 15062 - RNA, 54 nt, Artificial Sequence
  derived and/or modified sequence opt1 from anti-influenza_CDR
gugcgcuggcgggccgccgcggucaucauggaccaguucuacaagauggacgug

SEQ ID NO: 15063 - RNA, 54 nt, Artificial Sequence
  derived and/or modified sequence opt1 from anti-influenza_CDR
gccgugcccggccccaucuucgggaucuucccgcccuggagcuacuucgaccac

SEQ ID NO: 15064 - RNA, 54 nt, Artificial Sequence
  derived and/or modified sequence opt1 from anti-influenza_CDR
gccgccagcaccgcgaccuccggcacguacuacgccaugcgccccuucgacuuc

SEQ ID NO: 15065 - RNA, 57 nt, Artificial Sequence
  derived and/or modified sequence opt1 from anti-influenza_CDR
gcccgcggcaagcggcccggguacugcagcggcggggugugcuccagcgacuacugg

SEQ ID NO: 15066 - RNA, 57 nt, Artificial Sequence
  derived and/or modified sequence opt1 from anti-influenza_CDR
gcccgccacuaccccuacuacgaccugccgaccggcuucuacagccaguucgacuuc

SEQ ID NO: 15067 - RNA, 57 nt, Artificial Sequence
  derived and/or modified sequence opt1 from anti-influenza_CDR
ggcagcgggggcuacgggggcuucgacuacuucgggaagcugcgcaccugggacuuc

SEQ ID NO: 15068 - RNA, 57 nt, Artificial Sequence
  derived and/or modified sequence opt1 from anti-influenza_CDR
uucauccgcacccggcccuggggcgggaccgccgacacggccgcgagcgugaagggc

SEQ ID NO: 15069 - RNA, 57 nt, Artificial Sequence
  derived and/or modified sequence opt1 from anti-influenza_CDR
cugaacuaccacgacagcggcaccuacuacaacgccccgcgcgggugguucgacccc

SEQ ID NO: 15070 - RNA, 57 nt, Artificial Sequence
  derived and/or modified sequence opt1 from anti-influenza_CDR
gugaaggacggcuacugcacccugaccagcugccccgucgggugguacuucgaccuc

SEQ ID NO: 15071 - RNA, 57 nt, Artificial Sequence
  derived and/or modified sequence opt1 from anti-influenza_CDR
gccgugcccggccccaucuucgggaucuucccgcccuggagcuacuucgaccacugg

SEQ ID NO: 15072 - RNA, 57 nt, Artificial Sequence
  derived and/or modified sequence opt1 from anti-influenza_CDR
gcccgcgccaugauccagggcguggucacccuguaccuccggcccggggacuacugg

SEQ ID NO: 15073 - RNA, 57 nt, Artificial Sequence
  derived and/or modified sequence opt1 from anti-influenza_CDR
gccaaggugggccccuacaccggguacgacgacuacaacuacuacggcauggacguc

SEQ ID NO: 15074 - RNA, 57 nt, Artificial Sequence
  derived and/or modified sequence opt1 from anti-influenza_CDR
gccaagguggagcgcagcuucuacgacggcuccggguacggcgacgcccuggagauc

SEQ ID NO: 15075 - RNA, 57 nt, Artificial Sequence
  derived and/or modified sequence opt1 from anti-influenza_CDR
uacugcgcccgcggccgggugaacagcggguacgacuggggccccaacuucgacucc

SEQ ID NO: 15076 - RNA, 57 nt, Artificial Sequence
  derived and/or modified sequence opt1 from anti-influenza_CDR
uucugcgcccgcggcagccccaacuccggguacgacuggggcccgcacuucgacuac

SEQ ID NO: 15077 - RNA, 57 nt, Artificial Sequence
  derived and/or modified sequence opt1 from anti-influenza_CDR
cgcaucaagagcaacaccgacggcgggaccacggacuacgccgcccccgugaagggc

SEQ ID NO: 15078 - RNA, 57 nt, Artificial Sequence
  derived and/or modified sequence opt1 from anti-influenza_CDR
cugcgccuccagggcgagguggucgugcccccgagccaguccaacugguucgacccc

SEQ ID NO: 15079 - RNA, 60 nt, Artificial Sequence
  derived and/or modified sequence opt1 from anti-influenza_CDR
gccaaggagggcgggaacaccaucuucggccuggugaccauggccuacuacuucgacagc

SEQ ID NO: 15080 - RNA, 60 nt, Artificial Sequence
  derived and/or modified sequence opt1 from anti-influenza_CDR
gcccgcgccggcggggacagcuccggcuacuacggggcgcugggccgguucuuccagcac

SEQ ID NO: 15081 - RNA, 60 nt, Artificial Sequence
  derived and/or modified sequence opt1 from anti-influenza_CDR
gccaaggacagccgcggcuacugcuccagcaucaucugcuucgagggcgggcuggacaac

SEQ ID NO: 15082 - RNA, 60 nt, Artificial Sequence
  derived and/or modified sequence opt1 from anti-influenza_CDR
ggcagcggguccagcgaccgcuccgacuacgacccccacuacuacuacuaccuggacgug

SEQ ID NO: 15083 - RNA, 60 nt, Artificial Sequence
  derived and/or modified sequence opt1 from anti-influenza_CDR
ggcaccgaccccgacaccgagguguacugccgcgucgggaacugcgccgccuucgacuac

SEQ ID NO: 15084 - RNA, 60 nt, Artificial Sequence
  derived and/or modified sequence opt1 from anti-influenza_CDR
ggcaccagccacgugucccgcuacuucgacuggcugcccccgaccaacugguucgacccc

SEQ ID NO: 15085 - RNA, 60 nt, Artificial Sequence
  derived and/or modified sequence opt1 from anti-influenza_CDR
ggcaccgaccccgacaccgagggguacugccgcagcggcuccugcagcgccuucgacuuc

SEQ ID NO: 15086 - RNA, 60 nt, Artificial Sequence
  derived and/or modified sequence opt1 from anti-influenza_CDR
ggcaccgaccccgacaccgagguguacugccgcgccgggaacugcgccgcguucgacuuc

SEQ ID NO: 15087 - RNA, 60 nt, Artificial Sequence
  derived and/or modified sequence opt1 from anti-influenza_CDR
cgcggcgggcacagcuucggcuacggguccggcggggacacccacagcgaguucgacucc

SEQ ID NO: 15088 - RNA, 60 nt, Artificial Sequence
  derived and/or modified sequence opt1 from anti-influenza_CDR
cacaugagcaugcagcaggucguguccgccggcugggagcgcgccgaccuggugggggac

SEQ ID NO: 15089 - RNA, 60 nt, Artificial Sequence
  derived and/or modified sequence opt1 from anti-influenza_CDR
gacagccgccugcggucccuccuguacuucgaguggcugagccagggcuacuucaacccc

SEQ ID NO: 15090 - RNA, 60 nt, Artificial Sequence
  derived and/or modified sequence opt1 from anti-influenza_CDR
gcccgccaccugggccagcagcucgugagcaacaccuacuacuacuacgggauggacguc

SEQ ID NO: 15091 - RNA, 63 nt, Artificial Sequence
  derived and/or modified sequence opt1 from anti-influenza_CDR
accaccggcgggaccacgaccugcaccgccgccggcugcgggggcgggugcugcacgugcugc

SEQ ID NO: 15092 - RNA, 63 nt, Artificial Sequence
  derived and/or modified sequence opt1 from anti-influenza_CDR
gcccgcgccgcggacgagagcguggagucccugaccaucaaggccuuccggaccaacuaccac

SEQ ID NO: 15093 - RNA, 63 nt, Artificial Sequence
  derived and/or modified sequence opt1 from anti-influenza_CDR
gcccgcaugccccuggccaacuacgaccuccugaccggccuguacaucggggcguucgaccuc

SEQ ID NO: 15094 - RNA, 63 nt, Artificial Sequence
  derived and/or modified sequence opt1 from anti-influenza_CDR
gacaugcuggccuacuacagcgacaacuccggcaagaaguacaacguguacgggauggacguc

SEQ ID NO: 15095 - RNA, 63 nt, Artificial Sequence
  derived and/or modified sequence opt1 from anti-influenza_CDR
gacaugcuggccuacuacuacgacggcagcgggauccgcuacaaccucuacggcauggacgug

SEQ ID NO: 15096 - RNA, 66 nt, Artificial Sequence
  derived and/or modified sequence opt1 from anti-influenza_CDR
gccaaggacccccgccugcggcaccuccuguacuucccguucaccagcaugaucuacuucgacuac

SEQ ID NO: 15097 - RNA, 66 nt, Artificial Sequence
  derived and/or modified sequence opt1 from anti-influenza_CDR
gccaaggacagccagcugcgcucccuccuguacuucgaguggcugagccagggcuacuucgacccc

SEQ ID NO: 15098 - RNA, 66 nt, Artificial Sequence
  derived and/or modified sequence opt1 from anti-influenza_CDR
gccaaggacagccagcugcgcucccuccuguacuucgaguggcugagccagggcuacuucgacuac

SEQ ID NO: 15099 - RNA, 66 nt, Artificial Sequence
  derived and/or modified sequence opt1 from anti-influenza_CDR
gccaaggacagccagcugcgcucccuccuguacuucgaguggcugagccagggcuacuucgagccc

SEQ ID NO: 15100 - RNA, 66 nt, Artificial Sequence
  derived and/or modified sequence opt1 from anti-influenza_CDR
gccaaggagcgcccccugcggcuccugcgcuacuucgacuggcugagcggcggggccaacgacuac

SEQ ID NO: 15101 - RNA, 66 nt, Artificial Sequence
  derived and/or modified sequence opt1 from anti-influenza_CDR
gcccgcgacgugcacaacuacgacuuccugaccggcuacccccuccaccuguacgggauggacguc

SEQ ID NO: 15102 - RNA, 66 nt, Artificial Sequence
  derived and/or modified sequence opt1 from anti-influenza_CDR
gcccgcgacggccgggagggguacuucuacggcagcggguccuucuacaaccugaagggccucaac

SEQ ID NO: 15103 - RNA, 66 nt, Artificial Sequence
  derived and/or modified sequence opt1 from anti-influenza_CDR
agcaccgaccgcggccacgugcugcgguacuucggguggaugcuccccggcgacgccuucgacguc

SEQ ID NO: 15104 - RNA, 66 nt, Artificial Sequence
  derived and/or modified sequence opt1 from anti-influenza_CDR
cugaacuacuacgaccgcagcggcuaccacucccccgacgggccgagcaacaacugguucgacccc

SEQ ID NO: 15105 - RNA, 66 nt, Artificial Sequence
  derived and/or modified sequence opt1 from anti-influenza_CDR
gcccgcgugccccgggaccgccugcucacccuguacuacgagagcuccaccuacggcuucgacuac

SEQ ID NO: 15106 - RNA, 66 nt, Artificial Sequence
  derived and/or modified sequence opt1 from anti-influenza_CDR
gcccgcaaguggggccggaugaccguguucggggucgccaccgaccagcuguacuacuucgacuac

SEQ ID NO: 15107 - RNA, 66 nt, Artificial Sequence
  derived and/or modified sequence opt1 from anti-influenza_CDR
gccaccgacaucguggucgagcgcgacgccagccugggcggguucaacuccuacggcauggacgug

SEQ ID NO: 15108 - RNA, 69 nt, Artificial Sequence
  derived and/or modified sequence opt1 from anti-influenza_CDR
gcccgcaaccugcccgacaucgccguggucaccgcggugcaggacgccaccccggugugguucgacccc

SEQ ID NO: 15109 - RNA, 69 nt, Artificial Sequence
  derived and/or modified sequence opt1 from anti-influenza_CDR
gacggccccuacagcgacgacuuccgcuccggguacgccgcccgguaccgcuacuucggcauggacgug

SEQ ID NO: 15110 - RNA, 72 nt, Artificial Sequence
  derived and/or modified sequence opt1 from anti-influenza_CDR
ggccgcgagcugcuccggcugcagcacuuccugaccgacagccaguccgagcgccgggacugcuucgacccc

SEQ ID NO: 15111 - RNA, 72 nt, Artificial Sequence
  derived and/or modified sequence opt1 from anti-influenza_CDR
augagccugcucaccgagguggagacccccacgcgcaacgaguggggcugccggugcaacgacuccagcgac

SEQ ID NO: 15112 - RNA, 72 nt, Artificial Sequence
  derived and/or modified sequence opt1 from anti-influenza_CDR
augagccugcucaccgagguggagacccccacgaagaacgagugggagugccgcugcaacgacuccagcgac

SEQ ID NO: 15113 - RNA, 72 nt, Artificial Sequence
  derived and/or modified sequence opt1 from anti-influenza_CDR
augagccugcucaccgagguggagacccccauccgcaacgagugggagugccggugcaacgacuccagcgac

SEQ ID NO: 15114 - RNA, 72 nt, Artificial Sequence
  derived and/or modified sequence opt1 from anti-influenza_CDR
augagccugcucaccgagguggagacccccauccgcaacggcugggagugcaagugcaacgacuccagcgac

SEQ ID NO: 15115 - RNA, 72 nt, Artificial Sequence
  derived and/or modified sequence opt1 from anti-influenza_CDR
augagccugcucaccgagguggagacccccauccgcuccgaguggggcugccggugcaacgacagcuccgac

SEQ ID NO: 15116 - RNA, 72 nt, Artificial Sequence
  derived and/or modified sequence opt1 from anti-influenza_CDR
augagcuuccugcccgagguggagaccccgauccgcaacgaguggggcugccggugcaacgacuccagcgac

SEQ ID NO: 15117 - RNA, 72 nt, Artificial Sequence
  derived and/or modified sequence opt1 from anti-influenza_CDR
augagccugcucaccgagguggagacccccauccgcaacgaguggggcugccggugcaacgacuccagcaac

SEQ ID NO: 15118 - RNA, 72 nt, Artificial Sequence
  derived and/or modified sequence opt1 from anti-influenza_CDR
augagccugcucaccgagguggagacccccauccgcaaggaguggggcugccggugcaacgacuccagcgac

SEQ ID NO: 15119 - RNA, 72 nt, Artificial Sequence
  derived and/or modified sequence opt1 from anti-influenza_CDR
augagcuuccugaccgagguggagacccccauccgcaacgaguggggcugccggugcaacgacuccagcgac

SEQ ID NO: 15120 - RNA, 72 nt, Artificial Sequence
  derived and/or modified sequence opt1 from anti-influenza_CDR
augagccugcccaccgagguggagaccccgauccgcuccgaguggggcugccggugcaacgacagcuccgac

SEQ ID NO: 15121 - RNA, 72 nt, Artificial Sequence
  derived and/or modified sequence opt1 from anti-influenza_CDR
augagccugcuccccgagguggagaccccgauccgcaacgaguggggcugccggugcaacgacuccagcgac

SEQ ID NO: 15122 - RNA, 72 nt, Artificial Sequence
  derived and/or modified sequence opt1 from anti-influenza_CDR
augagccugcuccccgagguggagaccccgauccgcaacggcugggggugccggugcaacgacuccagcgac

SEQ ID NO: 15123 - RNA, 72 nt, Artificial Sequence
  derived and/or modified sequence opt1 from anti-influenza_CDR
augagccugcucaccgagguggagacccccacgcgcaacggcugggagugccggugcuccgggagcuccgac

SEQ ID NO: 15124 - RNA, 72 nt, Artificial Sequence
  derived and/or modified sequence opt1 from anti-influenza_CDR
augagccugcucaccgagguggagacccccauccgcaacgagugggaguaccggugcaacgacuccagcgac

SEQ ID NO: 15125 - RNA, 72 nt, Artificial Sequence
  derived and/or modified sequence opt1 from anti-influenza_CDR
augagccugcucaccgagguggagacccccauccgcaacgagugggaguaccggugcuccgacagcuccgac

SEQ ID NO: 15126 - RNA, 72 nt, Artificial Sequence
  derived and/or modified sequence opt1 from anti-influenza_CDR
augagccugcucaccgagguggagacccccacgcgcaacggcugggagugccgguacuccgacagcuccgac

SEQ ID NO: 15127 - RNA, 72 nt, Artificial Sequence
  derived and/or modified sequence opt1 from anti-influenza_CDR
augagcuuccugaccgagguggagacccucacgcgcaacggcugggagugccggugcuccgacagcuccgac

SEQ ID NO: 15128 - RNA, 72 nt, Artificial Sequence
  derived and/or modified sequence opt1 from anti-influenza_CDR
augagccugcucaccgagguggagacccugacgcgcaacggcugggagugcaagugccgggacuccagcgac

SEQ ID NO: 15129 - RNA, 72 nt, Artificial Sequence
  derived and/or modified sequence opt1 from anti-influenza_CDR
augagccugcucaccgagguggagacccccauccgcaacgaguggggcugccggugcaacgacuccagcgac

SEQ ID NO: 15130 - RNA, 72 nt, Artificial Sequence
  derived and/or modified sequence opt1 from anti-influenza_CDR
augagccugcucaccgagguggagacccccauccgcuccgaguggggcugccggugcaacgacagcggggac

SEQ ID NO: 15131 - RNA, 72 nt, Artificial Sequence
  derived and/or modified sequence opt1 from anti-influenza_CDR
augagccugcucaccgagguggagacccccauccgcaacgagugggagugccggugcaacggcuccagcgac

SEQ ID NO: 15132 - RNA, 72 nt, Artificial Sequence
  derived and/or modified sequence opt1 from anti-influenza_CDR
augagccugcccaccgagguggagaccccgauccgcaacgaguggggcugccggugcaacgacuccagcgac

SEQ ID NO: 15133 - RNA, 72 nt, Artificial Sequence
  derived and/or modified sequence opt1 from anti-influenza_CDR
augagccugcucaccgagguggagacccccauccgcaacgaguggggcugccggugcaacggguccagcgac

SEQ ID NO: 15134 - RNA, 72 nt, Artificial Sequence
  derived and/or modified sequence opt1 from anti-influenza_CDR
augagccugcucaccgagguggacacccugacgcgcaacggcugggggugccggugcuccgacagcuccgac

SEQ ID NO: 15135 - RNA, 72 nt, Artificial Sequence
  derived and/or modified sequence opt1 from anti-influenza_CDR
augagccugcucaccgagguggagacccugacgaagaacggcugggggugccgcugcuccgacagcuccgac

SEQ ID NO: 15136 - RNA, 72 nt, Artificial Sequence
  derived and/or modified sequence opt1 from anti-influenza_CDR
augagccugcucaccgagguggagacccccacgcgcaacggcugggagugcaagugcuccgacagcuccgac

SEQ ID NO: 15137 - RNA, 72 nt, Artificial Sequence
  derived and/or modified sequence opt1 from anti-influenza_CDR
augagccugcucaccgagguggagacccacacgcgcaacggcugggagugcaagugcuccgacagcuccgac

SEQ ID NO: 15138 - RNA, 72 nt, Artificial Sequence
  derived and/or modified sequence opt1 from anti-influenza_CDR
augagccugcucaccgaggugaagacccccacgcgcaacggcugggagugcaagugcuccgacagcuccgac

SEQ ID NO: 15139 - RNA, 72 nt, Artificial Sequence
  derived and/or modified sequence opt1 from anti-influenza_CDR
augagccugcucaccgagguggagacccugacgcgcaacggcugggggugccggugcuccgacagcuccgac

SEQ ID NO: 15140 - RNA, 72 nt, Artificial Sequence
  derived and/or modified sequence opt1 from anti-influenza_CDR
augagccugcucaccgagguggagacccccacgcgcgacggcugggagugcaagugcuccgacagcuccgac

SEQ ID NO: 15141 - RNA, 72 nt, Artificial Sequence
  derived and/or modified sequence opt1 from anti-influenza_CDR
augagccugcucaccgagguggagacccccacgcgcaacggcugggggugccggugcuccgacagcuccgac

SEQ ID NO: 15142 - RNA, 72 nt, Artificial Sequence
  derived and/or modified sequence opt1 from anti-influenza_CDR
augagccugcucaccgagguggagacccccacgcgcaacggcugggagugcaagugcaacgacuccagcgac

SEQ ID NO: 15143 - RNA, 72 nt, Artificial Sequence
  derived and/or modified sequence opt1 from anti-influenza_CDR
augagccugcucaccgagguggagacccugacgcgcaacggcugggagugcaagugcuccgacagcuccgac

SEQ ID NO: 15144 - RNA, 72 nt, Artificial Sequence
  derived and/or modified sequence opt1 from anti-influenza_CDR
augagccugcucaccgagguggagacccccauccgcaacgaguggggcugcaagugcaacgacuccagcgac

SEQ ID NO: 15145 - RNA, 72 nt, Artificial Sequence
  derived and/or modified sequence opt1 from anti-influenza_CDR
augagcuuccugaccgagguggagacccccauccgcaacgaguggggcugccggugcaacggguccagcgac

SEQ ID NO: 15146 - RNA, 72 nt, Artificial Sequence
  derived and/or modified sequence opt1 from anti-influenza_CDR
augagccugcucaccgagguggagacccccacgcgcaacggcugggagugccggugcaacgacuccagcgac

SEQ ID NO: 15147 - RNA, 72 nt, Artificial Sequence
  derived and/or modified sequence opt1 from anti-influenza_CDR
augagccugcucaccgagguggagacccccauccgcaagggcugggagugcaacugcuccgacagcuccgac

SEQ ID NO: 15148 - RNA, 72 nt, Artificial Sequence
  derived and/or modified sequence opt1 from anti-influenza_CDR
augagccugcucaccgagguggagacccccacgcgcaacgagugggagugccggugcuccgacagcuccgac

SEQ ID NO: 15149 - RNA, 72 nt, Artificial Sequence
  derived and/or modified sequence opt1 from anti-influenza_CDR
augagccugcucaccggcguggagacccacacgcgcaacggguggggcugcaagugcuccgacagcuccgac

SEQ ID NO: 15150 - RNA, 72 nt, Artificial Sequence
  derived and/or modified sequence opt1 from anti-influenza_CDR
augagccugcuccccgagguggagacccacacccgcaacggcugggggugccggugcuccgacagcuccgac

SEQ ID NO: 15151 - RNA, 72 nt, Artificial Sequence
  derived and/or modified sequence opt1 from anti-influenza_CDR
accgacggccccuacagcgacgacuuccgcuccggguacgccgcccgguaccgcuacuucggcauggacgug

SEQ ID NO: 15152 - RNA, 75 nt, Artificial Sequence
  derived and/or modified sequence opt1 from anti-influenza_CDR
gccaagcacaugagccugcagcaggucguguccgccggcugggagcgcgcggaccucgugggggacgccuucgac

SEQ ID NO: 15153 - RNA, 75 nt, Artificial Sequence
  derived and/or modified sequence opt1 from anti-influenza_CDR
gccaagcaccugagcaugcagcaggucguguccgccggcugggagcgcgcggaccucgugggggacgccuucgac

SEQ ID NO: 15154 - RNA, 75 nt, Artificial Sequence
  derived and/or modified sequence opt1 from anti-influenza_CDR
gccaagcacgccagccugcagcaggucguguccgcgggcugggagcgcgccgaccucgugggggacgccuucgac

SEQ ID NO: 15155 - RNA, 75 nt, Artificial Sequence
  derived and/or modified sequence opt1 from anti-influenza_CDR
gccaagcacagcucccugcagcaggucgugagcgccggcugggagcgcgcggaccucgugggggacgccuucgac

SEQ ID NO: 15156 - RNA, 75 nt, Artificial Sequence
  derived and/or modified sequence opt1 from anti-influenza_CDR
gccaagcaccugagccuccagcaggucguguccgccggcugggagcgcgcggaccuggugggggacgccuucgac

SEQ ID NO: 15157 - RNA, 75 nt, Artificial Sequence
  derived and/or modified sequence opt1 from anti-influenza_CDR
gccaagcacaugagcaugcagcaggucguguccgccggcugggagcgcgcggaccuggugggggacgccuucgac

SEQ ID NO: 15158 - RNA, 75 nt, Artificial Sequence
  derived and/or modified sequence opt1 from anti-influenza_CDR
gcccgcggccccgagaccuacuacuacgacaagaccaacuggcugaacagccacccggacgaguacuuccagcac

SEQ ID NO: 15159 - RNA, 75 nt, Artificial Sequence
  derived and/or modified sequence opt1 from anti-influenza_CDR
accaccgacggccccuacagcgacgacuuccgcuccggguacgccgcccgguaccgcuacuucggcauggacgug

SEQ ID NO: 15160 - RNA, 75 nt, Artificial Sequence
  derived and/or modified sequence opt1 from anti-influenza_CDR
accgacggccccuacagcgacgacuuccgcuccggguacgccgcccgguaccgcuacuucggcauggacgugugg

SEQ ID NO: 15161 - RNA, 78 nt, Artificial Sequence
  derived and/or modified sequence opt1 from anti-influenza_CDR
gacauccagaugacccagagccccuccagccuguccgccagcgugggcgaccgcgucaccaucacgugccgguccagc

SEQ ID NO: 15162 - RNA, 78 nt, Artificial Sequence
  derived and/or modified sequence opt1 from anti-influenza_CDR
gccaccggccgcgccgcgaccgggagcgccuccugcacgggcgggggcaccuacuggaccuacugcacgugcaccacc

SEQ ID NO: 15163 - RNA, 81 nt, Artificial Sequence
  derived and/or modified sequence opt1 from anti-influenza_CDR
ggcuacauccccgaggccccgcgcgacgggcaggccuacgugcggaaggacggcgaguggguccugcucagcaccuuccug

SEQ ID NO: 15164 - RNA, 90 nt, Artificial Sequence
  derived and/or modified sequence opt1 from anti-influenza_CDR
caggugcagcugcucgagaccggcgggggccuggucaagcccgggcagagccugaagcucuccugcgccgccagcggcuucaccuucacg

SEQ ID NO: 15165 - RNA, 96 nt, Artificial Sequence
  derived and/or modified sequence opt1 from anti-influenza_CDR
cgcuucaccaucagccgggacaacuccaagaacacccuguaccuccagaugaacagccugcgcgccgaggacacggccguguacuacugcgcgaag

SEQ ID NO: 15166 - RNA, 96 nt, Artificial Sequence
  derived and/or modified sequence opt1 from anti-influenza_CDR
ggcgugcccagccgcuucuccgggagcggcuccgggaccgacuucacccugacgaucagcucccuccagccggaggacuucgccaccuacuacugc

SEQ ID NO: 15167 - RNA, 15 nt, Artificial Sequence
  derived and/or modified sequence opt1 from anti-OX40_HeavyChain_CDR1
agcuacuccaugaac

SEQ ID NO: 15168 - RNA, 15 nt, Artificial Sequence
  derived and/or modified sequence opt1 from anti-OX40_HeavyChain_CDR1
gacuacgccaugcac

SEQ ID NO: 15169 - RNA, 15 nt, Artificial Sequence
  derived and/or modified sequence opt1 from anti-OX40_HeavyChain_CDR1
gacagcuacaugucc

SEQ ID NO: 15170 - RNA, 15 nt, Artificial Sequence
  derived and/or modified sequence opt1 from anti-OX40_HeavyChain_CDR1
gacgccuacaugagc

SEQ ID NO: 15171 - RNA, 15 nt, Artificial Sequence
  derived and/or modified sequence opt1 from anti-OX40_HeavyChain_CDR1
gagagcuacaugucc

SEQ ID NO: 15172 - RNA, 15 nt, Artificial Sequence
  derived and/or modified sequence opt1 from anti-OX40_HeavyChain_CDR1
agcggcuacuggaac

SEQ ID NO: 15173 - RNA, 21 nt, Artificial Sequence
  derived and/or modified sequence opt1 from anti-OX40_LightChain_CDR2
uacaccagccgccugcacucc

SEQ ID NO: 15174 - RNA, 21 nt, Artificial Sequence
  derived and/or modified sequence opt1 from anti-OX40_LightChain_CDR2
gccgccagcucccugcagagc

SEQ ID NO: 15175 - RNA, 21 nt, Artificial Sequence
  derived and/or modified sequence opt1 from anti-OX40_LightChain_CDR2
gacgccagcaaccgcgccacc

SEQ ID NO: 15176 - RNA, 21 nt, Artificial Sequence
  derived and/or modified sequence opt1 from anti-OX40_LightChain_CDR2
uacaccagccgccugcggucc

SEQ ID NO: 15177 - RNA, 24 nt, Artificial Sequence
  derived and/or modified sequence opt1 from anti-OX40_LightChain_CDR3
cagcagcgcagcaacuggcccacc

SEQ ID NO: 15178 - RNA, 24 nt, Artificial Sequence
  derived and/or modified sequence opt1 from anti-OX40_HeavyChain_CDR3
gccccccgcugguacuucagcgug

SEQ ID NO: 15179 - RNA, 24 nt, Artificial Sequence
  derived and/or modified sequence opt1 from anti-OX40_HeavyChain_CDR3
gccccccgcugguacuucagcgcc

SEQ ID NO: 15180 - RNA, 24 nt, Artificial Sequence
  derived and/or modified sequence opt1 from anti-OX40_HeavyChain_CDR3
gccccccgcugguacuucgccgug

SEQ ID NO: 15181 - RNA, 27 nt, Artificial Sequence
  derived and/or modified sequence opt1 from anti-OX40_LightChain_CDR3
cagcagggcaacacccugcccuggacc

SEQ ID NO: 15182 - RNA, 27 nt, Artificial Sequence
  derived and/or modified sequence opt1 from anti-OX40_HeavyChain_CDR3
gagagcggcugguaccuguucgacuac

SEQ ID NO: 15183 - RNA, 27 nt, Artificial Sequence
  derived and/or modified sequence opt1 from anti-OX40_LightChain_CDR3
cagcaguacaacagcuacccgcccacc

SEQ ID NO: 15184 - RNA, 27 nt, Artificial Sequence
  derived and/or modified sequence opt1 from anti-OX40_LightChain_CDR3
cagcagggccacacccugcccccgacc

SEQ ID NO: 15185 - RNA, 27 nt, Artificial Sequence
  derived and/or modified sequence opt1 from anti-OX40_LightChain_CDR3
cagcagggccacacccugcccgccacc

SEQ ID NO: 15186 - RNA, 27 nt, Artificial Sequence
  derived and/or modified sequence opt1 from anti-OX40_LightChain_CDR3
cagcagggccacaccgccccgcccacc

SEQ ID NO: 15187 - RNA, 27 nt, Artificial Sequence
  derived and/or modified sequence opt1 from anti-OX40_LightChain_CDR3
cagcagggcgccacccugcccccgacc

SEQ ID NO: 15188 - RNA, 27 nt, Artificial Sequence
  derived and/or modified sequence opt1 from anti-OX40_LightChain_CDR3
cagcagggccacgcccugcccccgacc

SEQ ID NO: 15189 - RNA, 27 nt, Artificial Sequence
  derived and/or modified sequence opt1 from anti-OX40_LightChain_CDR3
cagcaggcccacacccugcccccgacc

SEQ ID NO: 15190 - RNA, 27 nt, Artificial Sequence
  derived and/or modified sequence opt1 from anti-OX40_LightChain_CDR3
cagcagggccacacccuggcccccacc

SEQ ID NO: 15191 - RNA, 27 nt, Artificial Sequence
  derived and/or modified sequence opt1 from anti-OX40_LightChain_CDR3
caggccggccacacccugcccccgacc

SEQ ID NO: 15192 - RNA, 30 nt, Artificial Sequence
  derived and/or modified sequence opt1 from anti-OX40_HeavyChain_CDR1
ggcuacaccuucaccagcuacgugaugcac

SEQ ID NO: 15193 - RNA, 30 nt, Artificial Sequence
  derived and/or modified sequence opt1 from anti-OX40_HeavyChain_CDR3
uacuacggcagcucccugagcauggacuac

SEQ ID NO: 15194 - RNA, 33 nt, Artificial Sequence
  derived and/or modified sequence opt1 from anti-OX40_LightChain_CDR1
cgcgccagccaggacaucuccaacuaccugaac

SEQ ID NO: 15195 - RNA, 33 nt, Artificial Sequence
  derived and/or modified sequence opt1 from anti-OX40_LightChain_CDR1
cgcgccagccagggcaucuccagcuggcuggcc

SEQ ID NO: 15196 - RNA, 33 nt, Artificial Sequence; identical to SEQ ID NO: 14714
  derived and/or modified sequence opt1 from anti-OX40_LightChain_CDR1

SEQ ID NO: 15197 - RNA, 39 nt, Artificial Sequence
  derived and/or modified sequence opt1 from anti-OX40_HeavyChain_CDR3
uaccgcuacgacuacgacggcgggcacgccauggacuac

SEQ ID NO: 15198 - RNA, 39 nt, Artificial Sequence
  derived and/or modified sequence opt1 from anti-OX40_HeavyChain_CDR3
uacaaguacgacuacgacgccggccacgccauggacuac

SEQ ID NO: 15199 - RNA, 39 nt, Artificial Sequence
  derived and/or modified sequence opt1 from anti-OX40_HeavyChain_CDR3
uacaaguacgacuacgacggcgggcacgccauggacuac

SEQ ID NO: 15200 - RNA, 45 nt, Artificial Sequence
  derived and/or modified sequence opt1 from anti-OX40_HeavyChain_CDR3
gaccagagcaccgccgacuacuacuucuacuacggcauggacgug

SEQ ID NO: 15201 - RNA, 48 nt, Artificial Sequence
  derived and/or modified sequence opt1 from anti-OX40_HeavyChain_CDR2
uacaucagcuacaacggcaucaccuaccacaaccccagccugaagucc

SEQ ID NO: 15202 - RNA, 48 nt, Artificial Sequence
  derived and/or modified sequence opt1 from anti-OX40_HeavyChain_CDR2
uacaucagcuacaacgccaucaccuaccacaaccccagccugaagucc

SEQ ID NO: 15203 - RNA, 48 nt, Artificial Sequence
  derived and/or modified sequence opt1 from anti-OX40_HeavyChain_CDR2
uacaucagcuacuccggcaucaccuaccacaaccccagccugaagucc

SEQ ID NO: 15204 - RNA, 51 nt, Artificial Sequence
  derived and/or modified sequence opt1 from anti-OX40_HeavyChain_CDR2
uacaucaaccccuacaacgacggcaccaaguacaacgagaaguucaagggg

SEQ ID NO: 15205 - RNA, 51 nt, Artificial Sequence
  derived and/or modified sequence opt1 from anti-OX40_HeavyChain_CDR2
uacaucagcuccagcuccagcaccaucgacuacgccgacuccgugaagggc

SEQ ID NO: 15206 - RNA, 51 nt, Artificial Sequence
  derived and/or modified sequence opt1 from anti-OX40_HeavyChain_CDR2
ggcaucagcuggaacuccgggagcaucggcuacgccgacuccgugaagggg

SEQ ID NO: 15207 - RNA, 51 nt, Artificial Sequence
  derived and/or modified sequence opt1 from anti-OX40_HeavyChain_CDR2
gacauguaccccgacaacggcgacagcuccuacaaccagaaguuccgcgag

SEQ ID NO: 15208 - RNA, 51 nt, Artificial Sequence
  derived and/or modified sequence opt1 from anti-OX40_HeavyChain_CDR2
gacauguaccccgacaacgccgacagcuccuacaaccagaaguuccgcgag

SEQ ID NO: 15209 - RNA, 51 nt, Artificial Sequence
  derived and/or modified sequence opt1 from anti-OX40_HeavyChain_CDR2
gacauguaccccgacaacgccgacgccagcuacaaccagaaguuccgcgag

SEQ ID NO: 15210 - RNA, 51 nt, Artificial Sequence
  derived and/or modified sequence opt1 from anti-OX40_HeavyChain_CDR2
gacauguaccccgacaacggcgacgccagcuacaaccagaaguuccgcgag

SEQ ID NO: 15211 - RNA, 51 nt, Artificial Sequence
  derived and/or modified sequence opt1 from anti-OX40_HeavyChain_CDR2
gacauguaccccgacagcggcgacuccagcuacaaccagaaguuccgcgag

SEQ ID NO: 15212 - RNA, 51 nt, Artificial Sequence
  derived and/or modified sequence opt1 from anti-OX40_HeavyChain_CDR2
gacauguaccccgacaacggcagcuccagcuacaaccagaaguuccgcgag

SEQ ID NO: 15213 - RNA, 309 nt, Artificial Sequence
  derived and/or modified sequence opt1 from Ig_LightChain_kappa_constant_domain
accguggccgcccccagcgucuucaucuucccgcccuccgacgagcagcucaagagcggcaccgcguccguggugugccugcugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccagggccucuccagccccgugaccaaguccuucaaccgg

SEQ ID NO: 15214 - RNA, 309 nt, Artificial Sequence
  derived and/or modified sequence opt1 from Ig_LightChain_kappa_constant_domain
accguggccgcccccagcgucuucaucuucccgcccuccgacgagcagcucaagagcggcaccgcguccguggugugccugcugaacaacuucuacccccgcgaggccaagguccaguggaagguggacaacgcccugcagagcgggaacucccaggagagcgugacggagcaggacuccaaggacagcaccuacucccucagcaacacccugacccuguccaaggccgacuacgagaagcacaaggucuacgccugcgaggugacgcaccagggccucagcucccccgugaccaagagcuucaaccgg

SEQ ID NO: 15215 - RNA, 312 nt, Artificial Sequence
  derived and/or modified sequence opt1 from Ig_LightChain_lambda_constant_domain
cccaaggccgccccgagcgugacccuguucccgcccuccagcgaggagcuccaggcgaacaaggccacccuggucugccugaucuccgacuucuaccccggcgccgugacgguggccuggaaggccgacagcucccccgucaaggcggggguggagaccaccacccccagcaagcaguccaacaacaaguacgccgccagcuccuaccucagccugacgcccgagcaguggaagucccaccgcagcuacuccugccaggugacccacgagggcagcaccgucgagaagaccguggcccccacggagugcucc

SEQ ID NO: 15216 - RNA, 312 nt, Artificial Sequence
  derived and/or modified sequence opt1 from Ig_LightChain_lambda_constant_domain
cccaaggccgccccgagcgugacccuguucccgcccuccagcgaggagcuccaggcgaacaaggccacccuggucugccugaucuccgacuucuaccccggcgccgugacgguggccuggaaggccgacagcucccccgucaaggcggggguggagaccaccacccccagcaagcaguccaacaacaaguacgccgccagcuccuaccucagccugacgcccgagcaguggaagucccaccgcagcuacuccugccaggugacccacgagggcagcaccgucgagaagaccguggcccccgcggagugcucc

SEQ ID NO: 15217 - RNA, 312 nt, Artificial Sequence
  derived and/or modified sequence opt1 from Ig_LightChain_lambda_constant_domain
cccaaggccgccccgagcgugacccuguucccgcccuccagcgaggagcuccaggcgaacaaggccacccuggucugccugaucuccgacuucuaccccggcgccgugacgguggccuggaaggccgacagcucccccgucaaggcggggguggagaccaccacccccagcaagcaguccaacaacaaguacgccgccagcuccuaccucagccugacgcccgagcaguggaagucccacaagagcuacuccugccaggugacccacgagggcagcaccgucgagaagaccguggcccccacggagugcucc

SEQ ID NO: 15218 - RNA, 312 nt, Artificial Sequence
  derived and/or modified sequence opt1 from Ig_LightChain_lambda_constant_domain
cccaaggccgccccgagcgugacccuguucccgcccuccagcgaggagcuccaggcgaacaaggccacccuggucugccugaucuccgacuucuaccccggcgccgugacgguggccuggaaggccgacagcucccccgucaaggcggggguggagaccaccacccccagcaagcaguccaacaacaaguacgccgccagcuccuaccucagccugacgcccgagcaguggaagucccacaagagcuacuccugccaggugacccacgagggcagcaccgucgagaagaccguggcccccgcggagugcucc

SEQ ID NO: 15219 - RNA, 282 nt, Artificial Sequence
  derived and/or modified sequence opt1 from IgG1_HeavyChain_CH1_constant_domain
agcgccuccaccaagggccccagcguguucccgcuggcccccuccagcaaguccaccagcgggggcacggcggcccucgggugccuggucaaggacuacuuccccgagcccgugaccguguccuggaacagcggcguccacaccuucccggccgugcugcaguccagcgggcucuacucccugagcuccguggucaccgugcccagcuccagccugggcacgcagaccuacaucugcaacgugaaccacaagcccuccaacaccaaggucgacaagaaggug

SEQ ID NO: 15220 - RNA, 270 nt, Artificial Sequence
  derived and/or modified sequence opt1 from IgG1_HeavyChain_CH1_constant_domain
agcggccccuccguguucccgcuggcccccagcuccaagagcaccuccgggggcaccgccgcgcucgggugccuggucaaggacuacuuccccgagcccgugacggugagcuggaacuccggcguccacaccuucccggccgugcugcagagcuccgggcucuacagccuguccagcguggucaccgugcccuccagcucccugggcacccagacguacaucugcaacgugaaccacaagcccagcaacaccaaggucgacaagaaggug

SEQ ID NO: 15221 - RNA, 270 nt, Artificial Sequence
  derived and/or modified sequence opt1 from IgG1_HeavyChain_CH1_constant_domain
agcggccccuccguguucccgcuggcccccagcuccaagagcaccuccgggggcaccgccgcgcucgggugccuggucaaggacuacuuccccgagcccgugacggugagcuggaacuccggcguccacaccuucccggccgugcugcagagcuccgggcucuacagccuguccagcguggucaccgugcccuccagcucccugggcacccagacguacaucugcaacgugaaccacaagcccagcaacaccaaggucgacaagaaggcc

SEQ ID NO: 15222 - RNA, 270 nt, Artificial Sequence
  derived and/or modified sequence opt1 from IgG1_HeavyChain_CH1_constant_domain
agcggccccuccguguucccgcuggcccccagcuccaagagcaccuccgggggcaccgccgcgcucgggugccuggucaaggacuacuuccccgagcccgugacggugagcuggaacuccggcguccacaccuucccggccgugcugcagagcuccgggcucuacagccuguccagcguggucaccgugcccuccagcucccugggcacccagacguacaucugcaacgugaaccacaagcccagcaacaccaaggucgacaagcgcgug

SEQ ID NO: 15223 - RNA, 270 nt, Artificial Sequence
  derived and/or modified sequence opt1 from IgG1_HeavyChain_CH1_constant_domain
agcggccccuccguguucccgcuggcccccagcuccaagagcaccuccgggggcaccgccgcgcucgggugccuggucaaggacuacuuccccgagcccgugacggugagcuggaacuccggcguccacaccuucccggccgugcugcagagcuccgggcucuacagccuguccagcguggucaccgugcccuccagcucccugggcacccagacguacaucugcaacgugaaccacaagcccagcaacaccaaggucgacaagcgcgcc

SEQ ID NO: 15224 - RNA, 270 nt, Artificial Sequence
  derived and/or modified sequence opt1 from IgG1_HeavyChain_CH1_constant_domain
agcggccccuccgugcugccgcucgcccccagcuccaagagcaccuccgggggcaccgccgcgcuggggugccuggucaaggacuacuuccccgagcccgugacggugagcuggaacuccggcguccacaccuucccggccgugcuccagagcuccgggcuguacagccuguccagcguggucaccgugcccuccagcucccucggcacccagacguacaucugcaacgugaaccacaagcccagcaacaccaaggucgacaagaaggug

SEQ ID NO: 15225 - RNA, 270 nt, Artificial Sequence
  derived and/or modified sequence opt1 from IgG1_HeavyChain_CH1_constant_domain
agcggccccuccgugcugccgcucgcccccagcuccaagagcaccuccgggggcaccgccgcgcuggggugccuggucaaggacuacuuccccgagcccgugacggugagcuggaacuccggcguccacaccuucccggccgugcuccagagcuccgggcuguacagccuguccagcguggucaccgugcccuccagcucccucggcacccagacguacaucugcaacgugaaccacaagcccagcaacaccaaggucgacaagaaggcc

SEQ ID NO: 15226 - RNA, 270 nt, Artificial Sequence
  derived and/or modified sequence opt1 from IgG1_HeavyChain_CH1_constant_domain
agcggccccuccgugcugccgcucgcccccagcuccaagagcaccuccgggggcaccgccgcgcuggggugccuggucaaggacuacuuccccgagcccgugacggugagcuggaacuccggcguccacaccuucccggccgugcuccagagcuccgggcuguacagccuguccagcguggucaccgugcccuccagcucccucggcacccagacguacaucugcaacgugaaccacaagcccagcaacaccaaggucgacaagcgcgug

SEQ ID NO: 15227 - RNA, 270 nt, Artificial Sequence
  derived and/or modified sequence opt1 from IgG1_HeavyChain_CH1_constant_domain
agcggccccuccgugcugccgcucgcccccagcuccaagagcaccuccgggggcaccgccgcgcuggggugccuggucaaggacuacuuccccgagcccgugacggugagcuggaacuccggcguccacaccuucccggccgugcuccagagcuccgggcuguacagccuguccagcguggucaccgugcccuccagcucccucggcacccagacguacaucugcaacgugaaccacaagcccagcaacaccaaggucgacaagcgcgcc

SEQ ID NO: 15228 - RNA, 282 nt, Artificial Sequence
  derived and/or modified sequence opt1 from IgG1_HeavyChain_CH1_constant_domain
agcgccuccaccaagggccccagcguguucccgcuggcccccuccagcaaguccaccagcgggggcacggcggcccucgggugccuggucaaggacuacuuccccgagcccgugaccguguccuggaacagcggcguccacaccuucccggccgugcugcaguccagcgggcucuacucccugagcuccguggucaccgugcccagcuccagccugggcacgcagaccuacaucugcaacgugaaccacaagcccuccaacaccaaggucgacaagaaggcc

SEQ ID NO: 15229 - RNA, 282 nt, Artificial Sequence
  derived and/or modified sequence opt1 from IgG1_HeavyChain_CH1_constant_domain
agcgccuccaccaagggccccagcguguucccgcuggcccccuccagcaaguccaccagcgggggcacggcggcccucgggugccuggucaaggacuacuuccccgagcccgugaccguguccuggaacagcggcguccacaccuucccggccgugcugcaguccagcgggcucuacucccugagcuccguggucaccgugcccagcuccagccugggcacgcagaccuacaucugcaacgugaaccacaagcccuccaacaccaaggucgacaagcgcgug

SEQ ID NO: 15230 - RNA, 282 nt, Artificial Sequence
  derived and/or modified sequence opt1 from IgG1_HeavyChain_CH1_constant_domain
agcgccuccaccaagggccccagcguguucccgcuggcccccuccagcaaguccaccagcgggggcacggcggcccucgggugccuggucaaggacuacuuccccgagcccgugaccguguccuggaacagcggcguccacaccuucccggccgugcugcaguccagcgggcucuacucccugagcuccguggucaccgugcccagcuccagccugggcacgcagaccuacaucugcaacgugaaccacaagcccuccaacaccaaggucgacaagcgcgcc

SEQ ID NO: 15231 - RNA, 282 nt, Artificial Sequence
  derived and/or modified sequence opt1 from IgG1_HeavyChain_CH1_constant_domain
agcgccuccaccaagggccccagcgugcugccgcucgcccccuccagcaaguccaccagcgggggcacggcggcccuggggugccuggucaaggacuacuuccccgagcccgugaccguguccuggaacagcggcguccacaccuucccggccgugcuccaguccagcgggcuguacucccugagcuccguggucaccgugcccagcuccagccucggcacgcagaccuacaucugcaacgugaaccacaagcccuccaacaccaaggucgacaagaaggug

SEQ ID NO: 15232 - RNA, 282 nt, Artificial Sequence
  derived and/or modified sequence opt1 from IgG1_HeavyChain_CH1_constant_domain
agcgccuccaccaagggccccagcgugcugccgcucgcccccuccagcaaguccaccagcgggggcacggcggcccuggggugccuggucaaggacuacuuccccgagcccgugaccguguccuggaacagcggcguccacaccuucccggccgugcuccaguccagcgggcuguacucccugagcuccguggucaccgugcccagcuccagccucggcacgcagaccuacaucugcaacgugaaccacaagcccuccaacaccaaggucgacaagaaggcc

SEQ ID NO: 15233 - RNA, 282 nt, Artificial Sequence
  derived and/or modified sequence opt1 from IgG1_HeavyChain_CH1_constant_domain
agcgccuccaccaagggccccagcgugcugccgcucgcccccuccagcaaguccaccagcgggggcacggcggcccuggggugccuggucaaggacuacuuccccgagcccgugaccguguccuggaacagcggcguccacaccuucccggccgugcuccaguccagcgggcuguacucccugagcuccguggucaccgugcccagcuccagccucggcacgcagaccuacaucugcaacgugaaccacaagcccuccaacaccaaggucgacaagcgcgug

SEQ ID NO: 15234 - RNA, 282 nt, Artificial Sequence
  derived and/or modified sequence opt1 from IgG1_HeavyChain_CH1_constant_domain
agcgccuccaccaagggccccagcgugcugccgcucgcccccuccagcaaguccaccagcgggggcacggcggcccuggggugccuggucaaggacuacuuccccgagcccgugaccguguccuggaacagcggcguccacaccuucccggccgugcuccaguccagcgggcuguacucccugagcuccguggucaccgugcccagcuccagccucggcacgcagaccuacaucugcaacgugaaccacaagcccuccaacaccaaggucgacaagcgcgcc

SEQ ID NO: 15235 - RNA, 330 nt, Artificial Sequence
  derived and/or modified sequence opt1 from IgG1_HeavyChain_CH2_constant_domain
gcccccgagcugcucggcgggccgagcguguuccuguucccgcccaagcccaaggacacccugaugaucucccgcacccccgaggucacgugcgugguggucgacgugagccacgaggaccccgaggugaaguucaacugguacgucgacggcguggaggugcacaacgccaagaccaagccccgggaggagcaguacaacuccaccuaccgcgucgugagcgugcucaccguccugcaccaggacuggcugaacgggaaggaguacaagugcaagguguccaacaaggcgcuccccgccccgaucgagaagacgaucagcaaggccaag

SEQ ID NO: 15236 - RNA, 330 nt, Artificial Sequence
  derived and/or modified sequence opt1 from IgG1_HeavyChain_CH2_constant_domain
gcccccgagcugcucggcgggccgagcguguuccuguucccgcccaagcccaaggacacccugaugaucucccgcacccccgaggucacgugcgugguggucgacgugagccacgaggaccccgaggugaaguucaacgucuacguggacggcguggagguccacaacgccaagaccaagccccgggaggagcaguacaacuccaccuaccgcguggugagcguccucaccgugcugcaccaggacuggcugaacgggaaggaguacaagugcaagguguccaacaaggcgcuccccgccccgaucgagaagacgaucagcaaggccaag

SEQ ID NO: 15237 - RNA, 330 nt, Artificial Sequence
  derived and/or modified sequence opt1 from IgG1_HeavyChain_CH2_constant_domain
gcccccgagcugcucggcgggccgagcguguuccuguucccgcccaagcccaaggacacccugaugaucucccgcacccccgaggucacgugcgugguggucgacgugagccacgaggaccccgaggugaaguucaacgucuacguggacggcguggagguccacaacgccaagaccaagccccgggaggagcaguacgcguccaccuaccgcguggugagcguccucaccgugcugcaccaggacuggcugaacgggaaggaguacaagugcaagguguccaacaaggcccuccccgccccgaucgagaagacgaucagcaaggccaag

SEQ ID NO: 15238 - RNA, 330 nt, Artificial Sequence
  derived and/or modified sequence opt1 from IgG1_HeavyChain_CH2_constant_domain
gcccccgagcugcucggcgggccgagcguguuccuguucccgcccaagcccaaggacacccugaugaucucccgcacccccgaggucacgugcgugguggucgacgugagccacgaggaccccgaggugaaguucaacugguacgucgacggcguggaggugcacaacgccaagaccaagccccgggaggagcaguacgcguccaccuaccgcgucgugagcgugcucaccguccugcaccaggacuggcugaacgggaaggaguacaagugcaagguguccaacaaggcccuccccgccccgaucgagaagacgaucagcaaggccaag

SEQ ID NO: 15239 - RNA, 330 nt, Artificial Sequence
  derived and/or modified sequence opt1 from IgG1_HeavyChain_CH2_constant_domain
gcccccgagcugcucggcgccccgagcguguuccuguucccgcccaagcccaaggacacccugaugaucucccgcacccccgaggucacgugcgugguggucgacgugagccacgaggaccccgaggugaaguucaacgucuacguggacgggguggagguccacaacgcgaagaccaagccccgggaggagcaguacaacuccaccuaccgcguggugagcguccucaccgugcugcaccaggacuggcugaacggcaaggaguacaagugcaagguguccaacaaggcccuccccgccccgaucgagaagacgaucagcaaggccaag

SEQ ID NO: 15240 - RNA, 330 nt, Artificial Sequence
  derived and/or modified sequence opt1 from IgG1_HeavyChain_CH2_constant_domain
gcccccgagcugcucggcgccccgagcguguuccuguucccgcccaagcccaaggacacccugaugaucucccgcacccccgaggucacgugcgugguggucgacgugagccacgaggaccccgaggugaaguucaacgucuacguggacgggguggagguccacaacgcgaagaccaagccccgggaggagcaguacgccuccaccuaccgcguggugagcguccucaccgugcugcaccaggacuggcugaacggcaaggaguacaagugcaagguguccaacaaggcccuccccgccccgaucgagaagacgaucagcaaggccaag

SEQ ID NO: 15241 - RNA, 330 nt, Artificial Sequence
  derived and/or modified sequence opt1 from IgG1_HeavyChain_CH2_constant_domain
gcccccgagcugcucggcgccccgagcguguuccuguucccgcccaagcccaaggacacccugaugaucucccgcacccccgaggucacgugcgugguggucgacgugagccacgaggaccccgaggugaaguucaacugguacgucgacgggguggaggugcacaacgcgaagaccaagccccgggaggagcaguacaacuccaccuaccgcgucgugagcgugcucaccguccugcaccaggacuggcugaacggcaaggaguacaagugcaagguguccaacaaggcccuccccgccccgaucgagaagacgaucagcaaggccaag

SEQ ID NO: 15242 - RNA, 330 nt, Artificial Sequence
  derived and/or modified sequence opt1 from IgG1_HeavyChain_CH2_constant_domain
gcccccgagcugcucggcgccccgagcguguuccuguucccgcccaagcccaaggacacccugaugaucucccgcacccccgaggucacgugcgugguggucgacgugagccacgaggaccccgaggugaaguucaacugguacgucgacgggguggaggugcacaacgcgaagaccaagccccgggaggagcaguacgccuccaccuaccgcgucgugagcgugcucaccguccugcaccaggacuggcugaacggcaaggaguacaagugcaagguguccaacaaggcccuccccgccccgaucgagaagacgaucagcaaggccaag

SEQ ID NO: 15243 - RNA, 330 nt, Artificial Sequence
  derived and/or modified sequence opt1 from IgG1_HeavyChain_CH2_constant_domain
gcccccgagcuggccggcgggccgagcguguuccucuucccgcccaagcccaaggacacccugaugaucucccgcacccccgaggucacgugcgugguggucgacgugagccacgaggaccccgaggugaaguucaacgucuacguggacggcguggagguccacaacgcgaagaccaagccccgggaggagcaguacaacuccaccuaccgcguggugagcguccugaccgugcuccaccaggacuggcugaacgggaaggaguacaagugcaagguguccaacaaggcccugcccgccccgaucgagaagacgaucagcaaggccaag

SEQ ID NO: 15244 - RNA, 330 nt, Artificial Sequence
  derived and/or modified sequence opt1 from IgG1_HeavyChain_CH2_constant_domain
gcccccgagcuggccggcgggccgagcguguuccucuucccgcccaagcccaaggacacccugaugaucucccgcacccccgaggucacgugcgugguggucgacgugagccacgaggaccccgaggugaaguucaacgucuacguggacggcguggagguccacaacgcgaagaccaagccccgggaggagcaguacgccuccaccuaccgcguggugagcguccugaccgugcuccaccaggacuggcugaacgggaaggaguacaagugcaagguguccaacaaggcccugcccgccccgaucgagaagacgaucagcaaggccaag

SEQ ID NO: 15245 - RNA, 330 nt, Artificial Sequence
  derived and/or modified sequence opt1 from IgG1_HeavyChain_CH2_constant_domain
gcccccgagcuggccggcgggccgagcguguuccucuucccgcccaagcccaaggacacccugaugaucucccgcacccccgaggucacgugcgugguggucgacgugagccacgaggaccccgaggugaaguucaacugguacgucgacggcguggaggugcacaacgcgaagaccaagccccgggaggagcaguacaacuccaccuaccgcgucgugagcgugcugaccguccuccaccaggacuggcugaacgggaaggaguacaagugcaagguguccaacaaggcccugcccgccccgaucgagaagacgaucagcaaggccaag

SEQ ID NO: 15246 - RNA, 330 nt, Artificial Sequence
  derived and/or modified sequence opt1 from IgG1_HeavyChain_CH2_constant_domain
gcccccgagcuggccggcgggccgagcguguuccucuucccgcccaagcccaaggacacccugaugaucucccgcacccccgaggucacgugcgugguggucgacgugagccacgaggaccccgaggugaaguucaacugguacgucgacggcguggaggugcacaacgcgaagaccaagccccgggaggagcaguacgccuccaccuaccgcgucgugagcgugcugaccguccuccaccaggacuggcugaacgggaaggaguacaagugcaagguguccaacaaggcccugcccgccccgaucgagaagacgaucagcaaggccaag

SEQ ID NO: 15247 - RNA, 330 nt, Artificial Sequence
  derived and/or modified sequence opt1 from IgG1_HeavyChain_CH2_constant_domain
gcccccgagcuggccggcgcgccgagcguguuccucuucccgcccaagcccaaggacacccugaugaucucccgcacccccgaggucacgugcgugguggucgacgugagccacgaggaccccgaggugaaguucaacgucuacguggacgggguggagguccacaacgccaagaccaagccccgggaggagcaguacaacuccaccuaccgcguggugagcguccugaccgugcuccaccaggacuggcugaacggcaaggaguacaagugcaagguguccaacaaggcccugcccgccccgaucgagaagacgaucagcaaggccaag

SEQ ID NO: 15248 - RNA, 330 nt, Artificial Sequence
  derived and/or modified sequence opt1 from IgG1_HeavyChain_CH2_constant_domain
gcccccgagcuggccggcgcgccgagcguguuccucuucccgcccaagcccaaggacacccugaugaucucccgcacccccgaggucacgugcgugguggucgacgugagccacgaggaccccgaggugaaguucaacgucuacguggacgggguggagguccacaacgccaagaccaagccccgggaggagcaguacgccuccaccuaccgcguggugagcguccugaccgugcuccaccaggacuggcugaacggcaaggaguacaagugcaagguguccaacaaggcccugcccgccccgaucgagaagacgaucagcaaggcgaag

SEQ ID NO: 15249 - RNA, 330 nt, Artificial Sequence
  derived and/or modified sequence opt1 from IgG1_HeavyChain_CH2_constant_domain
gcccccgagcuggccggcgcgccgagcguguuccucuucccgcccaagcccaaggacacccugaugaucucccgcacccccgaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcccugcccgccccgaucgagaagacgaucagcaaggccaag

SEQ ID NO: 15250 - RNA, 330 nt, Artificial Sequence
  derived and/or modified sequence opt1 from IgG1_HeavyChain_CH2_constant_domain
gcccccgagcuggccggcgcgccgagcguguuccucuucccgcccaagcccaaggacacccugaugaucucccgcacccccgaggucacgugcgugguggucgacgugagccacgaggaccccgaggugaaguucaacugguacgucgacgggguggaggugcacaacgccaagaccaagccccgggaggagcaguacgccuccaccuaccgcgucgugagcgugcugaccguccuccaccaggacuggcugaacggcaaggaguacaagugcaagguguccaacaaggcccugcccgccccgaucgagaagacgaucagcaaggcgaag

SEQ ID NO: 15251 - RNA, 330 nt, Artificial Sequence
  derived and/or modified sequence opt1 from IgG1_HeavyChain_CH2_constant_domain
gcccccgaggcccugggcgggccgagcguguuccucuucccgcccaagcccaaggacacccugaugaucucccgcacccccgaggucacgugcgugguggucgacgugagccacgaggaccccgaggugaaguucaacgucuacguggacggcguggagguccacaacgcgaagaccaagccccgggaggagcaguacaacuccaccuaccgcguggugagcguccugaccgugcuccaccaggacuggcugaacgggaaggaguacaagugcaagguguccaacaaggcccugcccgccccgaucgagaagacgaucagcaaggccaag

SEQ ID NO: 15252 - RNA, 330 nt, Artificial Sequence
  derived and/or modified sequence opt1 from IgG1_HeavyChain_CH2_constant_domain
gcccccgaggcccugggcgggccgagcguguuccucuucccgcccaagcccaaggacacccugaugaucucccgcacccccgaggucacgugcgugguggucgacgugagccacgaggaccccgaggugaaguucaacgucuacguggacggcguggagguccacaacgcgaagaccaagccccgggaggagcaguacgccuccaccuaccgcguggugagcguccugaccgugcuccaccaggacuggcugaacgggaaggaguacaagugcaagguguccaacaaggcccugcccgccccgaucgagaagacgaucagcaaggccaag

SEQ ID NO: 15253 - RNA, 330 nt, Artificial Sequence
  derived and/or modified sequence opt1 from IgG1_HeavyChain_CH2_constant_domain
gcccccgaggcccugggcgggccgagcguguuccucuucccgcccaagcccaaggacacccugaugaucucccgcacccccgaggucacgugcgugguggucgacgugagccacgaggaccccgaggugaaguucaacugguacgucgacggcguggaggugcacaacgcgaagaccaagccccgggaggagcaguacaacuccaccuaccgcgucgugagcgugcugaccguccuccaccaggacuggcugaacgggaaggaguacaagugcaagguguccaacaaggcccugcccgccccgaucgagaagacgaucagcaaggccaag

SEQ ID NO: 15254 - RNA, 330 nt, Artificial Sequence
  derived and/or modified sequence opt1 from IgG1_HeavyChain_CH2_constant_domain
gcccccgaggcccugggcgggccgagcguguuccucuucccgcccaagcccaaggacacccugaugaucucccgcacccccgaggucacgugcgugguggucgacgugagccacgaggaccccgaggugaaguucaacugguacgucgacggcguggaggugcacaacgcgaagaccaagccccgggaggagcaguacgccuccaccuaccgcgucgugagcgugcugaccguccuccaccaggacuggcugaacgggaaggaguacaagugcaagguguccaacaaggcccugcccgccccgaucgagaagacgaucagcaaggccaag

SEQ ID NO: 15255 - RNA, 330 nt, Artificial Sequence
  derived and/or modified sequence opt1 from IgG1_HeavyChain_CH2_constant_domain
gcccccgaggcccugggcgcgccgagcguguuccucuucccgcccaagcccaaggacacccugaugaucucccgcacccccgaggucacgugcgugguggucgacgugagccacgaggaccccgaggugaaguucaacgucuacguggacgggguggagguccacaacgccaagaccaagccccgggaggagcaguacaacuccaccuaccgcguggugagcguccugaccgugcuccaccaggacuggcugaacggcaaggaguacaagugcaagguguccaacaaggcccugcccgccccgaucgagaagacgaucagcaaggccaag

SEQ ID NO: 15256 - RNA, 330 nt, Artificial Sequence
  derived and/or modified sequence opt1 from IgG1_HeavyChain_CH2_constant_domain
gcccccgaggcccugggcgcgccgagcguguuccucuucccgcccaagcccaaggacacccugaugaucucccgcacccccgaggucacgugcgugguggucgacgugagccacgaggaccccgaggugaaguucaacgucuacguggacgggguggagguccacaacgccaagaccaagccccgggaggagcaguacgccuccaccuaccgcguggugagcguccugaccgugcuccaccaggacuggcugaacggcaaggaguacaagugcaagguguccaacaaggcccugcccgccccgaucgagaagacgaucagcaaggcgaag

SEQ ID NO: 15257 - RNA, 330 nt, Artificial Sequence
  derived and/or modified sequence opt1 from IgG1_HeavyChain_CH2_constant_domain
gcccccgaggcccugggcgcgccgagcguguuccucuucccgcccaagcccaaggacacccugaugaucucccgcacccccgaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcccugcccgccccgaucgagaagacgaucagcaaggccaag

SEQ ID NO: 15258 - RNA, 330 nt, Artificial Sequence
  derived and/or modified sequence opt1 from IgG1_HeavyChain_CH2_constant_domain
gcccccgaggcccugggcgcgccgagcguguuccucuucccgcccaagcccaaggacacccugaugaucucccgcacccccgaggucacgugcgugguggucgacgugagccacgaggaccccgaggugaaguucaacugguacgucgacgggguggaggugcacaacgccaagaccaagccccgggaggagcaguacgccuccaccuaccgcgucgugagcgugcugaccguccuccaccaggacuggcugaacggcaaggaguacaagugcaagguguccaacaaggcccugcccgccccgaucgagaagacgaucagcaaggcgaag

SEQ ID NO: 15259 - RNA, 330 nt, Artificial Sequence
  derived and/or modified sequence opt1 from IgG1_HeavyChain_CH2_constant_domain
gcccccgaggccgcgggcgggccgagcguguuccuguucccgcccaagcccaaggacacccucaugaucucccgcacccccgaggucacgugcgugguggucgacgugagccacgaggaccccgaggugaaguucaacgucuacguggacggcguggagguccacaacgccaagaccaagccccgggaggagcaguacaacuccaccuaccgcguggugagcguccugaccgugcugcaccaggacuggcucaacgggaaggaguacaagugcaagguguccaacaaggcccugcccgccccgaucgagaagacgaucagcaaggccaag

SEQ ID NO: 15260 - RNA, 330 nt, Artificial Sequence
  derived and/or modified sequence opt1 from IgG1_HeavyChain_CH2_constant_domain
gcccccgaggccgcgggcgggccgagcguguuccuguucccgcccaagcccaaggacacccucaugaucucccgcacccccgaggucacgugcgugguggucgacgugagccacgaggaccccgaggugaaguucaacgucuacguggacggcguggagguccacaacgccaagaccaagccccgggaggagcaguacgccuccaccuaccgcguggugagcguccugaccgugcugcaccaggacuggcucaacgggaaggaguacaagugcaagguguccaacaaggcccugcccgccccgaucgagaagacgaucagcaaggcgaag

SEQ ID NO: 15261 - RNA, 330 nt, Artificial Sequence
  derived and/or modified sequence opt1 from IgG1_HeavyChain_CH2_constant_domain
gcccccgaggccgcgggcgggccgagcguguuccuguucccgcccaagcccaaggacacccucaugaucucccgcacccccgaggucacgugcgugguggucgacgugagccacgaggaccccgaggugaaguucaacugguacgucgacggcguggaggugcacaacgccaagaccaagccccgggaggagcaguacaacuccaccuaccgcgucgugagcgugcugaccguccugcaccaggacuggcucaacgggaaggaguacaagugcaagguguccaacaaggcccugcccgccccgaucgagaagacgaucagcaaggccaag

SEQ ID NO: 15262 - RNA, 330 nt, Artificial Sequence
  derived and/or modified sequence opt1 from IgG1_HeavyChain_CH2_constant_domain
gcccccgaggccgcgggcgggccgagcguguuccuguucccgcccaagcccaaggacacccucaugaucucccgcacccccgaggucacgugcgugguggucgacgugagccacgaggaccccgaggugaaguucaacugguacgucgacggcguggaggugcacaacgccaagaccaagccccgggaggagcaguacgccuccaccuaccgcgucgugagcgugcugaccguccugcaccaggacuggcucaacgggaaggaguacaagugcaagguguccaacaaggcccugcccgccccgaucgagaagacgaucagcaaggcgaag

SEQ ID NO: 15263 - RNA, 330 nt, Artificial Sequence
  derived and/or modified sequence opt1 from IgG1_HeavyChain_CH2_constant_domain
gcccccgaggccgcgggcgccccgagcguguuccuguucccgcccaagcccaaggacacccucaugaucucccgcacccccgaggucacgugcgugguggucgacgugagccacgaggaccccgaggugaaguucaacgucuacguggacgggguggagguccacaacgccaagaccaagccccgggaggagcaguacaacuccaccuaccgcguggugagcguccugaccgugcugcaccaggacuggcucaacggcaaggaguacaagugcaagguguccaacaaggcccugcccgccccgaucgagaagacgaucagcaaggcgaag

SEQ ID NO: 15264 - RNA, 330 nt, Artificial Sequence
  derived and/or modified sequence opt1 from IgG1_HeavyChain_CH2_constant_domain
gcccccgaggccgcgggcgccccgagcguguuccuguucccgcccaagcccaaggacacccucaugaucucccgcacccccgaggucacgugcgugguggucgacgugagccacgaggaccccgaggugaaguucaacgucuacguggacgggguggagguccacaacgccaagaccaagccccgggaggagcaguacgccuccaccuaccgcguggugagcguccugaccgugcugcaccaggacuggcucaacggcaaggaguacaagugcaagguguccaacaaggcccugcccgcgccgaucgagaagacgaucagcaaggccaag

SEQ ID NO: 15265 - RNA, 330 nt, Artificial Sequence
  derived and/or modified sequence opt1 from IgG1_HeavyChain_CH2_constant_domain
gcccccgaggccgcgggcgccccgagcguguuccuguucccgcccaagcccaaggacacccucaugaucucccgcacccccgaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccugcaccaggacuggcucaacggcaaggaguacaagugcaagguguccaacaaggcccugcccgccccgaucgagaagacgaucagcaaggcgaag

SEQ ID NO: 15266 - RNA, 330 nt, Artificial Sequence
  derived and/or modified sequence opt1 from IgG1_HeavyChain_CH2_constant_domain
gcccccgaggccgcgggcgccccgagcguguuccuguucccgcccaagcccaaggacacccucaugaucucccgcacccccgaggucacgugcgugguggucgacgugagccacgaggaccccgaggugaaguucaacugguacgucgacgggguggaggugcacaacgccaagaccaagccccgggaggagcaguacgccuccaccuaccgcgucgugagcgugcugaccguccugcaccaggacuggcucaacggcaaggaguacaagugcaagguguccaacaaggcccugcccgcgccgaucgagaagacgaucagcaaggccaag

SEQ ID NO: 15267 - RNA, 318 nt, Artificial Sequence
  derived and/or modified sequence opt1 from IgG1_HeavyChain_CH3_constant_domain
ggccagccccgcgagccccagguguacacccugccgcccagccgggaggagaugaccaagaaccaggucucccucacgugccuggugaagggguucuaccccagcgacaucgccguggagugggaguccaacggccagcccgagaacaacuacaagaccaccccgcccguccuggacagcgacggguccuucuuccucuacagcaagcugaccguggacaagucccgcuggcagcagggcaacguguucagcugcuccgucaugcacgaggcccugcacaaccacuacacgcagaagucccucagccugagccccggg

SEQ ID NO: 15268 - RNA, 318 nt, Artificial Sequence
  derived and/or modified sequence opt1 from IgG1_HeavyChain_CH3_constant_domain
ggccagccccgcgagccccagguguacacccugccgcccagccgggaggagcucaccaagaaccaggucucccugacgugccuggugaagggguucuaccccagcgacaucgccguggagugggaguccaacggccagcccgagaacaacuacaagaccaccccgcccguccucgacagcgacggguccuucuuccuguacagcaagcugaccguggacaagucccgcuggcagcagggcaacguguucagcugcuccgucaugcacgaggcccuccacaaccacuacacgcagaagucccugagccugagccccggg

SEQ ID NO: 15269 - RNA, 318 nt, Artificial Sequence
  derived and/or modified sequence opt1 from IgG1_HeavyChain_CH3_constant_domain
ggccagccccgcgagccccagguguacacccugccgcccagccgggacgagaugaccaagaaccaggucucccucacgugccuggugaagggguucuaccccagcgacaucgccguggagugggaguccaacggccagcccgagaacaacuacaagaccaccccgcccguccuggacagcgacggguccuucuuccucuacagcaagcugaccguggacaagucccgcuggcagcagggcaacguguucagcugcuccgucaugcacgaggcccugcacaaccacuacacgcagaagucccucagccugagccccggg

SEQ ID NO: 15270 - RNA, 318 nt, Artificial Sequence
  derived and/or modified sequence opt1 from IgG1_HeavyChain_CH3_constant_domain
ggccagccccgcgagccccagguguacacccugccgcccagccgggacgagcucaccaagaaccaggucucccugacgugccuggugaagggguucuaccccagcgacaucgccguggagugggaguccaacggccagcccgagaacaacuacaagaccaccccgcccguccucgacagcgacggguccuucuuccuguacagcaagcugaccguggacaagucccgcuggcagcagggcaacguguucagcugcuccgucaugcacgaggcccuccacaaccacuacacgcagaagucccugagccugagccccggg

SEQ ID NO: 15271 - RNA, 297 nt, Artificial Sequence
  derived and/or modified sequence opt1 from IgG2_HeavyChain_CH1_constant_domain
agcgccuccaccaagggccccagcguguucccgcuggcccccugcucccgcagcaccuccgagagcacggcggcccucgggugccuggucaaggacuacuuccccgagcccgugaccguguccuggaacagcggcgcccugaccuccgggguccacaccuucccggccgugcuccagagcuccggccuguacagccuguccagcguggucacggugcccuccagcaacuucgggacccagaccuacacgugcaacguggaccacaagcccuccaacaccaaggucgacaagaccgug

SEQ ID NO: 15272 - RNA, 297 nt, Artificial Sequence
  derived and/or modified sequence opt1 from IgG2_HeavyChain_CH1_constant_domain
agcgccuccaccaagggccccagcguguucccgcuggcccccugcucccgcagcaccuccgagagcacggcggcccucgggugccuggucaaggacuacuuccccgagcccgugaccguguccuggaacagcggcgcccugaccuccgggguccacaccuucccggccgugcuccagagcuccggccuguacagccuguccagcguggucacggugaccuccagcaacuucgggacccagaccuacacgugcaacguggaccacaagcccuccaacaccaaggucgacaagaccgug

SEQ ID NO: 15273 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggguggagguccacaacgccaagaccaagccccgggaggagcaguucaacuccaccuuccgcguggugagcguccugaccguggugcaccaggacuggcugaacggcaaggaguacaagugcaaggucuccaacaaggggcucccggcccccaucgagaagacgaucagcaagaccaag

SEQ ID NO: 15274 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggguggagguccacaacgccaagaccaagccccgggaggagcaguucaacuccaccuuccgcguggugagcguccugaccguggugcaccaggacuggcugaacggcaaggaguacaagugcaaggucuccaacaaggggcucccggccagcaucgagaagacgaucuccaagaccaag

SEQ ID NO: 15275 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggguggagguccacaacgccaagaccaagccccgggaggagcaguucaacuccaccuuccgcguggugagcguccugaccguggugcaccaggacuggcugaacggcaaggaguacaagugcaaggucuccaacaaggggcucccgagccccaucgagaagacgaucuccaagaccaag

SEQ ID NO: 15276 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggguggagguccacaacgccaagaccaagccccgggaggagcaguucaacuccaccuuccgcguggugagcguccugaccguggugcaccaggacuggcugaacggcaaggaguacaagugcaaggucuccaacaaggggcucccgagcuccaucgagaagacgaucagcaagaccaag

SEQ ID NO: 15277 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggauggaggugcacaacgccaagaccaagccccgggaggagcaguucaacuccaccuuccgcgucgugagcgugcugaccgucgugcaccaggacuggcugaacggcaaggaguacaagugcaagguguccaacaaggggcucccggcccccaucgagaagacgaucagcaagaccaag

SEQ ID NO: 15278 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggauggaggugcacaacgccaagaccaagccccgggaggagcaguucaacuccaccuuccgcgucgugagcgugcugaccgucgugcaccaggacuggcugaacggcaaggaguacaagugcaagguguccaacaaggggcucccggccagcaucgagaagacgaucuccaagaccaag

SEQ ID NO: 15279 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggauggaggugcacaacgccaagaccaagccccgggaggagcaguucaacuccaccuuccgcgucgugagcgugcugaccgucgugcaccaggacuggcugaacggcaaggaguacaagugcaagguguccaacaaggggcucccgagccccaucgagaagacgaucuccaagaccaag

SEQ ID NO: 15280 - RNA, 327 nt, Artificial Sequence
  derived and/or modified sequence opt1 from IgG2_HeavyChain_CH2_constant_domain
gcgcccccgguggccggccccagcgucuuccuguucccgcccaagcccaaggacacccucaugaucucccgcacccccgaggugacgugcguggucguggacgugagccacgaggaccccgagguccaguucaacugguacguggacgggauggaggugcacaacgccaagaccaagccccgggaggagcaguucaacuccaccuuccgcgucgugagcgugcugaccgucgugcaccaggacuggcugaacggcaaggaguacaagugcaagguguccaacaaggggcucccgagcuccaucgagaagacgaucagcaagaccaag

SEQ ID NO: 15281 - RNA, 318 nt, Artificial Sequence
  derived and/or modified sequence opt1 from IgG2_HeavyChain_CH3_constant_domain
ggccagccccgcgagccccagguguacacccugccgcccagccgggaggagaugaccaagaaccaggucucccucacgugccuggugaagggguucuaccccagcgacaucgccguggagugggaguccaacggccagcccgagaacaacuacaagaccaccccgcccaugcuggacagcgacggguccuucuuccucuacagcaagcugaccgucgacaagucccgcuggcagcagggcaacguguucagcugcuccgugaugcacgaggcccugcacaaccacuacacgcagaagucccucagccugagccccggg

SEQ ID NO: 15282 - RNA, 297 nt, Artificial Sequence
  derived and/or modified sequence opt1 from IgG4_HeavyChain_CH1_constant_domain
agcgccuccaccaagggccccagcguguucccgcuggcccccugcucccgcagcaccuccgagagcacggcggcccucgggugccuggucaaggacuacuuccccgagcccgugaccguguccuggaacagcggcgcccugaccuccgggguccacaccuucccggccgugcuccagagcuccggccuguacagccuguccagcguggucacggugcccuccagcucccucgggaccaagaccuacacgugcaacguggaccacaagcccagcaacaccaaggucgacaagcgggug

SEQ ID NO: 15283 - RNA, 330 nt, Artificial Sequence
  derived and/or modified sequence opt1 from IgG4_HeavyChain_CH2_constant_domain
gcccccgaguuccugggcgggccgagcguguuccucuucccgcccaagcccaaggacacccugaugaucucccgcacccccgaggucacgugcgugguggucgacgugagccaggaggaccccgaggugcaguucaacugguacgucgacggcguggaggugcacaacgccaagaccaagccccgggaggagcaguucaacuccaccuaccgcgucgugagcgugcugaccguccuccaccaggacuggcugaacgggaaggaguacaagugcaagguguccaacaagggccugcccagcuccaucgagaagacgaucagcaaggcgaag

SEQ ID NO: 15284 - RNA, 318 nt, Artificial Sequence
  derived and/or modified sequence opt1 from IgG4_HeavyChain_CH3_constant_domain
ggccagccccgcgagccccagguguacacccugccgcccagccaggaggagaugaccaagaaccaggucucccucacgugccuggugaagggguucuaccccagcgacaucgccguggagugggaguccaacggccagcccgagaacaacuacaagaccaccccgcccguccuggacagcgacggguccuucuuccucuacagccggcugaccguggacaagucccgcuggcaggagggcaacguguucagcugcuccgucaugcacgaggcccugcacaaccacuacacgcagaagucccucagccugagccugggg

SEQ ID NO: 15285 - RNA, 1347 nt, Artificial Sequence
  derived and/or modified sequence opt2 from AAB-003_gamma1-Chain
gagguccagcuccucgaguccggcggcggccucguccagcccggcggcucccuccgccucuccugcgccgccuccggcuucaccuucuccaacuacggcauguccuggguccgccaggcccccggcaagggccucgagugggucgccuccauccgcuccggcggcggccgcaccuacuacuccgacaacgucaagggccgcuucaccaucucccgcgacaacuccaagaacacccucuaccuccagaugaacucccuccgcgccgaggacaccgccgucuacuacugcguccgcuacgaccacuacuccggcuccuccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15286 - RNA, 1329 nt, Artificial Sequence
  derived and/or modified sequence opt2 from Abagovomab_HeavyChain
caggucaagcuccaggaguccggcgccgagcucgcccgccccggcgccuccgucaagcucuccugcaaggccuccggcuacaccuucaccaacuacuggaugcagugggucaagcagcgccccggccagggccucgacuggaucggcgccaucuaccccggcgacggcaacacccgcuacacccacaaguucaagggcaaggccacccucaccgccgacaaguccuccuccaccgccuacaugcagcucuccucccucgccuccgaggacuccggcgucuacuacugcgcccgcggcgagggcaacuacgccugguucgccuacuggggccagggcaccaccgucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 15287 - RNA, 642 nt, Artificial Sequence
  derived and/or modified sequence opt2 from Abagovomab_LightChain
gacaucgagcucacccagucccccgccucccucuccgccuccgucggcgagaccgucaccaucaccugccaggccuccgagaacaucuacuccuaccucgccuggcaccagcagaagcagggcaaguccccccagcuccucgucuacaacgccaagacccucgccggcggcgucuccucccgcuucuccggcuccggcuccggcacccacuucucccucaagaucaagucccuccagcccgaggacuucggcaucuacuacugccagcaccacuacggcauccuccccaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15288 - RNA, 1350 nt, Artificial Sequence
  derived and/or modified sequence opt2 from Abciximab_HeavyChain
gagguccagcuccagcaguccggcgccgagcucgucaagcccggcgccuccgucaagcucuccugcaccgccuccggcuucaacaucaaggacaccuacguccacugggucaagcagcgccccgagcagggccucgaguggaucggccgcaucgaccccgccaacggcuacaccaaguacgaccccaaguuccagggcaaggccaccaucaccgccgacaccuccuccaacaccgccuaccuccagcucuccucccucaccuccgaggacaccgccgucuacuacugcguccgcccccucuacgacuacuacgccauggacuacuggggccagggcaccuccgucaccgucuccuccgccaagaccaccgcccccuccgucuacccccucgcccccgucugcggcgacaccaccggcuccuccgucacccucggcugccucgucaagggcuacuuccccgagcccgucacccucaccuggaacuccggcucccucuccuccggcguccacaccuuccccgccguccuccaguccgaccucuacacccucuccuccuccgucaccgucaccuccuccaccuggcccucccaguccaucaccugcaacgucgcccaccccgccuccuccaccaaggucgacaagaagaucgagccccgccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15289 - RNA, 642 nt, Artificial Sequence
  derived and/or modified sequence opt2 from Abciximab_LightChain
gacauccucaugacccagucccccuccuccauguccgucucccucggcgacaccgucuccaucaccugccacgccucccagggcaucuccuccaacaucggcuggcuccagcagaagcccggcaaguccuucaugggccucaucuacuacggcaccaaccucgucgacggcguccccucccgcuucuccggcuccggcuccggcgccgacuacucccucaccaucuccucccucgacuccgaggacuucgccgacuacuacugcguccaguacgcccagcuccccuacaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15290 - RNA, 1341 nt, Artificial Sequence
  derived and/or modified sequence opt2 from Abituzumab_HeavyChain1
cagguccagcuccagcaguccggcggcgagcucgccaagcccggcgccuccgucaaggucuccugcaaggccuccggcuacaccuucuccuccuucuggaugcacuggguccgccaggcccccggccagggccucgaguggaucggcuacaucaacccccgcuccggcuacaccgaguacaacgagaucuuccgcgacaaggccaccaugaccaccgacaccuccaccuccaccgccuacauggagcucuccucccuccgcuccgaggacaccgccgucuacuacugcgccuccuuccucggccgcggcgccauggacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcccaaguccuccgacaagacccacaccugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaggcccaguccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15291 - RNA, 642 nt, Artificial Sequence
  derived and/or modified sequence opt2 from Abituzumab_LightChain1
gacauccagaugacccagucccccuccucccucuccgccuccgucggcgaccgcgucaccaucaccugccgcgccucccaggacaucuccaacuaccucgccugguaccagcagaagcccggcaaggcccccaagcuccucaucuacuacaccuccaagauccacuccggcguccccucccgcuucuccggcuccggcuccggcaccgacuacaccuucaccaucuccucccuccagcccgaggacaucgccaccuacuacugccagcagggcaacaccuuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15292 - RNA, 1332 nt, Artificial Sequence
  derived and/or modified sequence opt2 from Abrilumab_HeavyChain1
cagguccagcucguccaguccggcgccgaggucaagaagcccggcgccuccgucaaggucuccugcaaggucuccggcuacacccucuccgaccucuccauccacuggguccgccaggcccccggcaagggccucgaguggaugggcggcuucgacccccaggacggcgagaccaucuacgcccagaaguuccagggccgcgucaccaugaccgaggacaccuccaccgacaccgccuacauggagcucuccucccucaaguccgaggacaccgccgucuacuacugcgccaccggcuccuccuccuccugguucgaccccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15293 - RNA, 642 nt, Artificial Sequence
  derived and/or modified sequence opt2 from Abrilumab_LightChain1
gacauccagaugacccagucccccuccuccgucuccgccuccgucggcgaccgcgucaccaucaccugccgcgccucccagggcaucuccuccuggcucgccugguaccagcagaagcccggcaaggcccccaagcuccucaucuacggcgccuccaaccucgaguccggcguccccucccgcuucuccggcuccggcuccggcaccgacuucacccucaccaucuccucccuccagcccgaggacuucgccaacuacuacugccagcaggccaacuccuuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15294 - RNA, 639 nt, Artificial Sequence
  derived and/or modified sequence opt2 from Abrilumab_LightChain1_variant2
cagaucguccucacccagucccccgccaucauguccgccucccccggcgagaaggucaccaucaccugcuccgccuccuccuccgucuccuacaugaacugguuccagcagaagcccggcaccucccccaagcucuggaucuacuccaccuccaaccucgccuccggcguccccgcccgcuucuccggcuccggcuccggcaccuccuacucccucaccaucucccgcauggaggccgaggacgccgccaccuacuacugccagcagcgcuccuccuaccccaacaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15295 - RNA, 1347 nt, Artificial Sequence
  derived and/or modified sequence opt2 from Actoxumab_HeavyChain1
gagguccagcucguccaguccggcgccgaggucaagaaguccggcgagucccucaagaucuccugcaagggcuccggcuacuccuucaccuccuacuggaucggcuggguccgccagaugcccggcaagggccucgaguggaugggcaucuucuaccccggcgacuccuccacccgcuacucccccuccuuccagggccaggucaccaucuccgccgacaaguccgucaacaccgccuaccuccagugguccucccucaaggccuccgacaccgccauguacuacugcgcccgccgccgcaacuggggcaacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15296 - RNA, 645 nt, Artificial Sequence
  derived and/or modified sequence opt2 from Actoxumab_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccaccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15297 - RNA, 672 nt, Artificial Sequence
  derived and/or modified sequence opt2 from Adalimumab_HeavyChain
gagguccagcucgucgaguccggcggcggccucguccagcccggccgcucccuccgccucuccugcgccgccuccggcuucaccuucgacgacuacgccaugcacuggguccgccaggcccccggcaagggccucgagugggucuccgccaucaccuggaacuccggccacaucgacuacgccgacuccgucgagggccgcuucaccaucucccgcgacaacgccaagaacucccucuaccuccagaugaacucccuccgcgccgaggacaccgccgucuacuacugcgccaaggucuccuaccucuccaccgccuccucccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 15298 - RNA, 642 nt, Artificial Sequence
  derived and/or modified sequence opt2 from Adalimumab_LightChain
gacauccagaugacccagucccccuccucccucuccgccuccgucggcgaccgcgucaccaucaccugccgcgccucccagggcauccgcaacuaccucgccugguaccagcagaagcccggcaaggcccccaagcuccucaucuacgccgccuccacccuccaguccggcguccccucccgcuucuccggcuccggcuccggcaccgacuucacccucaccaucuccucccuccagcccgaggacgucgccaccuacuacugccagcgcuacaaccgcgcccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15299 - RNA, 1359 nt, Artificial Sequence
  derived and/or modified sequence opt2 from Aducanumab_HeavyChain1
cagguccagcucgucgaguccggcggcggcgucguccagcccggccgcucccuccgccucuccugcgccgccuccggcuucgccuucuccuccuacggcaugcacuggguccgccaggcccccggcaagggccucgagugggucgccgucaucugguucgacggcaccaagaaguacuacaccgacuccgucaagggccgcuucaccaucucccgcgacaacuccaagaacacccucuaccuccagaugaacacccuccgcgccgaggacaccgccgucuacuacugcgcccgcgaccgcggcaucggcgcccgccgcggccccuacuacauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15300 - RNA, 642 nt, Artificial Sequence
  derived and/or modified sequence opt2 from Aducanumab_LightChain1
gacauccagaugacccagucccccuccucccucuccgccuccgucggcgaccgcgucaccaucaccugccgcgccucccaguccaucuccuccuaccucaacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaguccuacuccaccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15301 - RNA, 1359 nt, Artificial Sequence
  derived and/or modified sequence opt2 from Afasevikumab_HeavyChain1
gagguccagcucgucgaguccggcggcggccucguccagcccggccgcucccuccgccucuccugcgccgccuccggcuucaccuucgacgacuacgccaugcacuggguccgccaggcccccggcaagggccucgagugggucuccggcaucaacugguccuccggcggcaucggcuacgccgacuccgucaagggccgcuucaccaucucccgcgacaacgccaagaacucccucuaccuccagaugaacucccuccgcgccgaggacaccgcccucuacuacugcgcccgcgacaucggcggcuucggcgaguucuacuggaacuucggccucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15302 - RNA, 645 nt, Artificial Sequence
  derived and/or modified sequence opt2 from Afasevikumab_LightChain1
gagaucguccucacccagucccccgccacccucucccucucccccggcgagcgcgccacccucuccugccgcgccucccaguccguccgcuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccccgccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15303 - RNA, 1293 nt, Artificial Sequence
  derived and/or modified sequence opt2 from Aflibercept_Fusion_protein1
uccgacaccggccgccccuucgucgagauguacuccgagauccccgagaucauccacaugaccgagggccgcgagcucgucauccccugccgcgucaccucccccaacaucaccgucacccucaagaaguucccccucgacacccucauccccgacggcaagcgcaucaucugggacucccgcaagggcuucaucaucuccaacgccaccuacaaggagaucggccuccucaccugcgaggccaccgucaacggccaccucuacaagaccaacuaccucacccaccgccagaccaacaccaucaucgacgucguccucucccccucccacggcaucgagcucuccgucggcgagaagcucguccucaacugcaccgcccgcaccgagcucaacgucggcaucgacuucaacugggaguaccccuccuccaagcaccagcacaagaagcucgucaaccgcgaccucaagacccaguccggcuccgagaugaagaaguuccucuccacccucaccaucgacggcgucacccgcuccgaccagggccucuacaccugcgccgccuccuccggccucaugaccaagaagaacuccaccuucguccgcguccacgagaaggacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15304 - RNA, 1332 nt, Artificial Sequence
  derived and/or modified sequence opt2 from Afutuzuab_HeavyChain1
cagguccagcucguccaguccggcgccgaggucaagaagcccggcuccuccgucaaggucuccugcaaggccuccggcuacgccuucuccuacuccuggaucaacuggguccgccaggcccccggccagggccucgaguggggccgcaucuuccccggcgacggcgacaccgacuacaacggcaaguucaagggccgcgucaccaucaccgccgacaaguccaccuccaccgccuacgagcucuccucccuccgcuccgaggacaccgccgucuacuacugcgcccgcaacgucuucgacggcuacuggcucgucuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15305 - RNA, 651 nt, Artificial Sequence
  derived and/or modified sequence opt2 from Afutuzuab_LightChain1
gacaucgucacccagaccccccucucccuccccgucacccccggcgagcccgccuccaucuccugccgcuccuccaagucccuccuccacuccaacggcaucaccuaccucuacugguaccuccagaagcccggccaguccccccagcuccucaucuaccaguccaaccucgucuccggcguccccgaccgcuucuccggcuccggcuccggcaccgacuucacccucaagaucucccgcgucgaggccgaggacgucggcgucuacuacugcgcccagaaccucgagcuccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15306 - RNA, 1347 nt, Artificial Sequence
  derived and/or modified sequence opt2 from Afutuzumab_HeavyChain1
cagguccagcucguccaguccggcgccgaggucaagaagcccggcuccuccgucaaggucuccugcaaggccuccggcuacgccuucuccuacuccuggaucaacuggguccgccaggcccccggccagggccucgaguggaugggccgcaucuuccccggcgacggcgacaccgacuacaacggcaaguucaagggccgcgucaccaucaccgccgacaaguccaccuccaccgccuacauggagcucuccucccuccgcuccgaggacaccgccgucuacuacugcgcccgcaacgucuucgacggcuacuggcucgucuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15307 - RNA, 657 nt, Artificial Sequence
  derived and/or modified sequence opt2 from Afutuzumab_LightChain1
gacaucgucaugacccagaccccccucucccuccccgucacccccggcgagcccgccuccaucuccugccgcuccuccaagucccuccuccacuccaacggcaucaccuaccucuacugguaccuccagaagcccggccaguccccccagcuccucaucuaccagauguccaaccucgucuccggcguccccgaccgcuucuccggcuccggcuccggcaccgacuucacccucaagaucucccgcgucgaggccgaggacgucggcgucuacuacugcgcccagaaccucgagcuccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15308 - RNA, 684 nt, Artificial Sequence
  derived and/or modified sequence opt2 from Alacizumab_pegol_HeavyChain1
gagguccagcucgucgaguccggcggcggccucguccagcccggcggcucccuccgccucuccugcgccgccuccggcuucaccuucuccuccuacggcauguccuggguccgccaggcccccggcaagggccucgagugggucgccaccaucaccuccggcggcuccuacaccuacuacgucgacuccgucaagggccgcuucaccaucucccgcgacaacgccaagaacacccucuaccuccagaugaacucccuccgcgccgaggacaccgccgucuacuacugcguccgcaucggcgaggacgcccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcgccgcc

SEQ ID NO: 15309 - RNA, 642 nt, Artificial Sequence
  derived and/or modified sequence opt2 from Alacizumab_pegol_LightChain1
gacauccagaugacccagucccccuccucccucuccgccuccgucggcgaccgcgucaccaucaccugccgcgccucccaggacaucgccggcucccucaacuggcuccagcagaagcccggcaaggccaucaagcgccucaucuacgccaccuccucccucgacuccggcguccccaagcgcuucuccggcucccgcuccggcuccgacuacacccucaccaucuccucccuccagcccgaggacuucgccaccuacuacugccuccaguacggcuccuucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15310 - RNA, 1353 nt, Artificial Sequence
  derived and/or modified sequence opt2 from Alemtuzumab_HeavyChain
cagguccagcuccaggaguccggccccggccucguccgccccucccagacccucucccucaccugcaccgucuccggcuucaccuucaccgacuucuacaugaacuggguccgccagccccccggccgcggccucgaguggaucggcuucauccgcgacaaggccaagggcuacaccaccgaguacaaccccuccgucaagggccgcgucaccaugcucgucgacaccuccaagaaccaguucucccuccgccucuccuccgucaccgccgccgacaccgccgucuacuacugcgcccgcgagggccacaccgccgcccccuucgacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15311 - RNA, 657 nt, Artificial Sequence
  derived and/or modified sequence opt2 from Alemtuzumab_HeavyChain_variant_1bey_H
cagguccagcuccaggaguccggccccggccucguccgccccucccagacccucucccucaccugcaccgucuccggcuucaccuucaccgacuucuacaugaacuggguccgccagccccccggccgcggccucgaguggaucggcuucauccgcgacaaggccaagggcuacaccaccgaguacaaccccuccgucaagggccgcgucaccaugcucgucgacaccuccaagaaccaguucucccuccgccucuccuccgucaccgccgccgacaccgccgucuacuacugcgcccgcgagggccacaccgccgcccccuucgacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaagguc

SEQ ID NO: 15312 - RNA, 660 nt, Artificial Sequence
  derived and/or modified sequence opt2 from Alemtuzumab_HeavyChain_variant_1ce1_H
cagguccagcuccaggaguccggccccggccucguccgccccucccagacccucucccucaccugcaccgucuccggcuucaccuucaccgacuucuacaugaacuggguccgccagccccccggccgcggccucgaguggaucggcuucauccgcgacaaggccaagggcuacaccaccgaguacaaccccuccgucaagggccgcgucaccaugcucgucgacaccuccaagaaccaguucucccuccgccucuccuccgucaccgccgccgacaccgccgucuacuacugcgcccgcgagggccacaccgccgcccccuucgacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgag

SEQ ID NO: 15313 - RNA, 1311 nt, Artificial Sequence
  derived and/or modified sequence opt2 from Alemtuzumab_HeavyChain_variant_8005_H
cagguccagcuccaggaguccggccccggccucguccgccccucccagacccucucccucaccugcaccgucuccggcuucaccuucaccgacuucuacaugaacuggguccgccagccccccggccgcggccucgaguggaucggcuucauccgcgacaaggccaagggcuacaccaccgaguacaaccccuccgucaagggccgcgucaccaugcucgucgacaccuccaagaaccaguucucccuccgccucuccuccgucaccgccgccgacaccgccgucuacuacugcgcccgcgagggccacaccgccgcccccuucgacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgaggcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15314 - RNA, 633 nt, Artificial Sequence
  derived and/or modified sequence opt2 from Alemtuzumab_LightChain
gacauccagaugacccagucccccuccucccucuccgccuccgucggcgaccgcgucaccaucaccugcaaggccucccagaacaucgacaaguaccucaacugguaccagcagaagcccggcaaggcccccaagcuccucaucuacaacaccaacaaccuccagaccggcguccccucccgcuucuccggcuccggcuccggcaccgacuucaccuucaccaucuccucccuccagcccgaggacaucgccaccuacuacugccuccagcacaucucccgcccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 15315 - RNA, 642 nt, Artificial Sequence
  derived and/or modified sequence opt2 from Alemtuzumab_LightChain_variant_8005_L
gacauccagaugacccagucccccuccucccucuccgccuccgucggcgaccgcgucaccaucaccugcaaggccucccagaacaucgacaaguaccucaacugguaccagcagaagcccggcaaggcccccaagcuccucaucuacaacaccaacaaccuccagaccggcguccccucccgcuucuccggcuccggcuccggcaccgacuucaccuucaccaucuccucccuccagcccgaggacaucgccaccuacuacugccuccagcacaucucccgcccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15316 - RNA, 1341 nt, Artificial Sequence
  derived and/or modified sequence opt2 from Alirocumab_HeavyChain1
gagguccagcucgucgaguccggcggcggccucguccagcccggcggcucccuccgccucuccugcgccgccuccggcuucaccuucaacaacuacgccaugaacuggguccgccaggcccccggcaagggccucgacugggucuccaccaucuccggcuccggcggcaccaccaacuacgccgacuccgucaagggccgcuucaucaucucccgcgacuccuccaagcacacccucuaccuccagaugaacucccuccgcgccgaggacaccgccgucuacuacugcgccaaggacuccaacuggggcaacuucgaccucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15317 - RNA, 660 nt, Artificial Sequence
  derived and/or modified sequence opt2 from Alirocumab_LightChain1
gacaucgucaugacccagucccccgacucccucgccgucucccucggcgagcgcgccaccaucaacugcaaguccucccaguccguccucuaccgcuccaacaaccgcaacuuccucggcugguaccagcagaagcccggccagccccccaaccuccucaucuacugggccuccacccgcgaguccggcguccccgaccgcuucuccggcuccggcuccggcaccgacuucacccucaccaucuccucccuccaggccgaggacgucgccgucuacuacugccagcaguacuacaccacccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15318 - RNA, 735 nt, Artificial Sequence
  derived and/or modified sequence opt2 from ALX-0061_HeavyChain1
gagguccagcucgucgaguccggcggcggccucguccagcccggcggcucccuccgccucuccugcgccgccuccggcuccgucuucaagaucaacgucauggccugguaccgccaggcccccggcaagggccgcgagcucgucgccggcaucaucuccggcggcuccaccuccuacgccgacuccgucaagggccgcuucaccaucucccgcgacaacgccaagaacacccucuaccuccagaugaacucccuccgccccgaggacaccgccgucuacuacugcgccuucaucaccaccgaguccgacuacgaccucggccgccgcuacuggggccagggcacccucgucaccgucuccuccggcggcggcggcuccggcggcggcuccgagguccagcucgucgaguccggcggcggccucguccagcccggcaacucccuccgccucuccugcgccgccuccggcuucaccuucuccuccuucggcauguccuggguccgccaggcccccggcaagggccucgagugggucuccuccaucuccggcuccggcuccgacacccucuacgccgacuccgucaagggccgcuucaccaucucccgcgacaacgccaagaccacccucuaccuccagaugaacucccuccgccccgaggacaccgccgucuacuacugcaccaucggcggcucccucucccgcuccucccagggcacccucgucaccgucuccucc

SEQ ID NO: 15319 - RNA, 1347 nt, Artificial Sequence
  derived and/or modified sequence opt2 from Amatuximab_HeavyChain1
cagguccagcuccagcaguccggccccgagcucgagaagcccggcgccuccgucaagaucuccugcaaggccuccggcuacuccuucaccggcuacaccaugaacugggucaagcagucccacggcaagucccucgaguggaucggccucaucacccccuacaacggcgccuccuccuacaaccagaaguuccgcggcaaggccacccucaccgucgacaaguccuccuccaccgccuacauggaccuccucucccucaccuccgaggacuccgccgucuacuucugcgcccgcggcggcuacgacggccgcggcuucgacuacuggggcuccggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15320 - RNA, 639 nt, Artificial Sequence
  derived and/or modified sequence opt2 from Amatuximab_LightChain1
gacaucgagcucacccagucccccgccaucauguccgccucccccggcgagaaggucaccaugaccugcuccgccuccuccuccgucuccuacaugcacugguaccagcagaaguccggcaccucccccaagcgcuggaucuacgacaccuccaagcucgccuccggcguccccggccgcuucuccggcuccggcuccggcaacuccuacucccucaccaucuccuccgucgaggccgaggacgacgccaccuacuacugccagcagugguccaagcacccccucaccuucggcuccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15321 - RNA, 1350 nt, Artificial Sequence
  derived and/or modified sequence opt2 from Anetumab_ravtansine_HeavyChain1
caggucgagcucguccaguccggcgccgaggucaagaagcccggcgagucccucaagaucuccugcaagggcuccggcuacuccuucaccuccuacuggaucggcuggguccgccaggcccccggcaagggccucgaguggaugggcaucaucgaccccggcgacucccgcacccgcuacucccccuccuuccagggccaggucaccaucuccgccgacaaguccaucuccaccgccuaccuccagugguccucccucaaggccuccgacaccgccauguacuacugcgcccgcggccagcucuacggcggcaccuacauggacggcuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15322 - RNA, 651 nt, Artificial Sequence
  derived and/or modified sequence opt2 from Anetumab_ravtansine_LightChain1
gacaucgcccucacccagcccgccuccgucuccggcucccccggccaguccaucaccaucuccugcaccggcaccuccuccgacaucggcggcuacaacuccgucuccugguaccagcagcaccccggcaaggcccccaagcucaugaucuacggcgucaacaaccgccccuccggcgucuccaaccgcuucuccggcuccaaguccggcaacaccgccucccucaccaucuccggccuccaggccgaggacgaggccgacuacuacugcuccuccuacgacaucgaguccgccacccccgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaagggcgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15323 - RNA, 1341 nt, Artificial Sequence
  derived and/or modified sequence opt2 from Anifrolumab_HeavyChain1
gagguccagcucguccaguccggcgccgaggucaagaagcccggcgagucccucaagaucuccugcaagggcuccggcuacaucuucaccaacuacuggaucgccuggguccgccagaugcccggcaagggccucgaguccaugggcaucaucuaccccggcgacuccgacauccgcuacucccccuccuuccagggccaggucaccaucuccgccgacaaguccaucaccaccgccuaccuccagugguccucccucaaggccuccgacaccgccauguacuacugcgcccgccacgacaucgagggcuucgacuacuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaguucgagggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgccuccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15324 - RNA, 645 nt, Artificial Sequence
  derived and/or modified sequence opt2 from Anifrolumab_LightChain1
gagaucguccucacccagucccccggcacccucucccucucccccggcgagcgcgccacccucuccugccgcgccucccaguccgucuccuccuccuucuucgccugguaccagcagaagcccggccaggccccccgccuccucaucuacggcgccuccucccgcgccaccggcauccccgaccgccucuccggcuccggcuccggcaccgacuucacccucaccaucacccgccucgagcccgaggacuucgccgucuacuacugccagcaguacgacuccuccgccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15325 - RNA, 1344 nt, Artificial Sequence
  derived and/or modified sequence opt2 from Anrukinzumab_HeavyChain1
gagguccagcucgucgaguccggcggcggccucguccagcccggcggcucccuccgccucuccugcgccgccuccggcuucaccuucaucuccuacgccauguccuggguccgccaggcccccggcaagggccucgagugggucgccuccaucuccuccggcggcaacaccuacuaccccgacuccgucaagggccgcuucaccaucucccgcgacaacgccaagaacucccucuaccuccagaugaacucccuccgcgccgaggacaccgccgucuacuacugcgcccgccucgacggcuacuacuucggcuucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggcccucggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15326 - RNA, 654 nt, Artificial Sequence
  derived and/or modified sequence opt2 from Anrukinzumab_LightChain1
gacauccagaugacccagucccccuccucccucuccgccuccgucggcgaccgcgucaccaucaccugcaaggccuccgaguccgucgacaacuacggcaagucccucaugcacugguaccagcagaagcccggcaaggcccccaagcuccucaucuaccgcgccuccaaccucgaguccggcguccccucccgcuucuccggcuccggcuccggcaccgacuucacccucaccaucuccucccuccagcccgaggacuucgccaccuacuacugccagcaguccaacgaggaccccuggaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15327 - RNA, 1338 nt, Artificial Sequence
  derived and/or modified sequence opt2 from Apolizumab_HeavyChain1
cagguccagcuccaggaguccggccccggccucgucaagcccuccgagacccucucccucaccugcaccgucuccggcuucucccucaccaacuacggcguccacuggguccgccagucccccggcaagggccucgaguggaucggcgucaagugguccggcggcuccaccgaguacaacgccgccuucaucucccgccucaccaucuccaaggacaccuccaagaaccaggucucccucaagcucaacucccucaccgccgccgacaccgccgucuacuacugcgcccgcaacgaccgcuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15328 - RNA, 642 nt, Artificial Sequence
  derived and/or modified sequence opt2 from Apolizumab_LightChain1
gacauccagaugacccagucccccuccucccucuccgccuccgucggcgaccgcgucaccaucaccugccgcgccuccgagaacaucuacuccuaccucgccugguaccagcagaagcccggcaaggcccccaagcuccucgucuccaacgccaagacccucgccgagggcguccccucccgcuucuccggcuccggcuccggcaagcaguucacccucaccaucuccucccuccagcccgaggacuucgccaccuacuacugccagcaccacuacggcaacuccuaccccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15329 - RNA, 378 nt, Artificial Sequence
  derived and/or modified sequence opt2 from Apomab_HeavyChain
gagguccagcucguccaguccggcggcggcgucgagcgccccggcggcucccuccgccucuccugcgccgccuccggcuucaccuucgacgacuacgccauguggguccgccaggcccccggcaagggccucgagugggucuccggcaucaacuggcagggcggcuccaccggcuacgccgacuccgucaagggccgcgucaccaucucccgcgacaacgccaagaacucccucuaccuccagaugaacucccuccgcgccgaggacaccgccgucuacuacugcgccaagauccucggcgccggccgcggcugguacuucgacuacuggggcaagggcaccaccgucaccgucuccuccgccuccaccaagggcccc

SEQ ID NO: 15330 - RNA, 324 nt, Artificial Sequence
  derived and/or modified sequence opt2 from Apomab_LightChain
uccgagcucacccaggaccccgccgucuccgucgcccucggccagaccguccgcaucaccugcuccggcgacucccuccgcuccuacuacgccuccugguaccagcagaagcccggccaggcccccguccucgucaucuacggcgccaacaaccgccccuccggcauccccgaccgcuucuccggcuccuccuccggcaacaccgccucccucaccaucaccggcgcccaggccgaggacgaggccgacuacuacugcaacuccgccgacuccuccggcaaccacgucgucuucggcggcggcaccaagcucaccguccucggc

SEQ ID NO: 15331 - RNA, 645 nt, Artificial Sequence
  derived and/or modified sequence opt2 from Aquaporumab_LightChain
gagaucguccucacccagucccccggcacccucucccucucccccggcgagcgcgccacccucuccugccgcgccucccagaccguccgcaccaacuaccucgccugguuccagcagaagcccggccaggccccccgccuccucaucuucggcgccuccucccgcgccaccggcauccccgaccgcuucuccggcuccggcuccggcaccgacuucacccucaccaucucccgccucgagcccgaggacuucgccgucuacuacugccagcaguacggcuccucccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15332 - RNA, 1326 nt, Artificial Sequence
  derived and/or modified sequence opt2 from Arcitumomab_99tc_HeavyChain
gaggucaagcucgucgaguccggcggcggccucguccagcccggcggcucccuccgccucuccugcgccaccuccggcuucaccuucaccgacuacuacaugaacuggguccgccagccccccggcaaggcccucgaguggcucggcuucaucggcaacaaggccaacggcuacaccaccgaguacuccgccuccgucaagggccgcuucaccaucucccgcgacaagucccaguccauccucuaccuccagaugaacacccuccgcgccgaggacuccgccaccuacuacugcacccgcgaccgcggccuccgcuucuacuucgacuacuggggccagggcaccacccucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccccccgccccuccgagaccgucaccugcaacgucgcccaccccgccuccuccaccaaggucgacaagaagaucgucccccgcgacugcccccccugcaagugccccgcccccaaccuccucggcggccccuccgucuucaucuucccccccaagaucaaggacguccucaugaucucccucucccccaucgucaccugcgucgucgucgacgucuccgaggacgaccccgacguccagaucuccugguucgucaacaacgucgagguccacaccgcccagacccagacccaccgcgaggacuacaacuccacccuccgcgucgucuccgcccuccccauccagcaccaggacuggauguccggcaaggaguucaagugcaaggucaacaacaaggaccuccccgcccccaucgagcgcaccaucuccaagcccaagggcuccguccgcgccccccaggucuacguccuccccccccccgaggaggagaugaccaagaagcaggucacccucaccugcauggucaccgacuucaugcccgaggacaucuacgucgaguggaccaacaacggcaagaccgagcucaacuacaagaacaccgagcccguccucgacuccgacggcuccuacuucauguacuccaagcuccgcgucgagaagaagaacugggucgagcgcaacuccuacuccugcuccgucguccacgagggccuccacaaccaccacaccaccaaguccuucucccgc

SEQ ID NO: 15333 - RNA, 639 nt, Artificial Sequence
  derived and/or modified sequence opt2 from Arcitumomab_99tc_LightChain
cagaccguccucucccagucccccgccauccucuccgccucccccggcgagaaggucaccaugaccugccgcgccuccuccuccgucaccuacauccacugguaccagcagaagcccggcuccucccccaaguccuggaucuacgccaccuccaaccucgccuccggcguccccgcccgcuucuccggcuccggcuccggcaccuccuacucccucaccaucucccgcgucgaggccgaggacgccgccaccuacuacugccagcacugguccuccaagccccccaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15334 - RNA, 1329 nt, Artificial Sequence
  derived and/or modified sequence opt2 from Ascrinvacumab_HeavyChain1
cagguccagcuccaggaguccggccccggccucgucaagcccucccagacccucucccucaccugcaccgucuccggcggcuccaucuccuccggcgaguacuacuggaacuggauccgccagcaccccggcaagggccucgaguggaucggcuacaucuacuacuccggcuccaccuacuacaaccccucccucaagucccgcgucaccaucuccgucgacaccuccaagaaccaguucucccucaagcucuccuccgucaccgccgccgacaccgccgucuacuacugcgcccgcgaguccgucgccggcuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15335 - RNA, 645 nt, Artificial Sequence
  derived and/or modified sequence opt2 from Ascrinvacumab_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcaccuccucccgcgccaccggcauccccgaccgcuucuccggcuccggcuccggcaccgacuucacccucaccaucucccgccucgagcccgaggacuucgccgucuacuacugccagcaguacggcuccucccccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15336 - RNA, 1314 nt, Artificial Sequence
  derived and/or modified sequence opt2 from Aselizuab_HeavyChain1
gagguccagcucgucgaguccggcggcggccucguccagcccggcggcucccuccgccucuccugcgccgccuccggcuucaccuucuccaccuacgccuccuggguccgccaggcccccggcaagggccucgagugggucgccuccaucuccaccggcggcuccaccuacuaccccgacuccgucaagggccgcuucaccaucucccgcgacaacgccaagaacacccucuaccuccagaacucccuccgcgccgaggacaccgccgucuacuacugcgcccgcgacuacgacggcuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccguccacgaggcccuccacaaccacuacacccagaagucccucucccucucccucggcaag

SEQ ID NO: 15337 - RNA, 1311 nt, Artificial Sequence
  derived and/or modified sequence opt2 from Aselizuab_HeavyChain2
gagguccagcucgucgaguccggcggcggccucguccagcccggcggcucccuccgccucuccugcgccgccuccggcuucaccuucuccaccuacgccuccuggguccgccaggcccccggcaagggccucgagugggucgccuccaucuccaccggcggcuccaccuacuaccccgacuccgucaagggccgcuucaccaucucccgcgacaacgccaagaacacccucuaccuccagaacucccuccgcgccgaggacaccgccgucuacuacugcgcccgcgacuacgacggcuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacaccaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccguccacgaggcccuccacaaccacuacacccagaagucccucucccucucccucggcaag

SEQ ID NO: 15338 - RNA, 648 nt, Artificial Sequence
  derived and/or modified sequence opt2 from Aselizuab_LightChain1
gacauccagacccagucccccuccucccucuccgccuccgucggcgaccgcgucaccaucaccugcaaggccucccaguccgucgacuacgacggcgacuccuacaacugguaccagcagaagcccggcaaggcccccaagcuccucaucuacgccgccuccaaccucgaguccggcauccccucccgcuucuccggcuccggcuccggcaccgacuucacccucaccaucuccucccuccagcccgaggacuucgccaccuacuacugccagcaguccaacgaggaccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15339 - RNA, 1344 nt, Artificial Sequence
  derived and/or modified sequence opt2 from Atezolizumab_HeavyChain1
gagguccagcucgucgaguccggcggcggccucguccagcccggcggcucccuccgccucuccugcgccgccuccggcuucaccuucuccgacuccuggauccacuggguccgccaggcccccggcaagggccucgagugggucgccuggaucucccccuacggcggcuccaccuacuacgccgacuccgucaagggccgcuucaccaucuccgccgacaccuccaagaacaccgccuaccuccagaugaacucccuccgcgccgaggacaccgccgucuacuacugcgcccgccgccacuggcccggcggcuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15340 - RNA, 642 nt, Artificial Sequence
  derived and/or modified sequence opt2 from Atezolizumab_LightChain1
gacauccagaugacccagucccccuccucccucuccgccuccgucggcgaccgcgucaccaucaccugccgcgccucccaggacgucuccaccgccgucgccugguaccagcagaagcccggcaaggcccccaagcuccucaucuacuccgccuccuuccucuacuccggcguccccucccgcuucuccggcuccggcuccggcaccgacuucacccucaccaucuccucccuccagcccgaggacuucgccaccuacuacugccagcaguaccucuaccaccccgccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15341 - RNA, 1323 nt, Artificial Sequence
  derived and/or modified sequence opt2 from Atinumab_HeavyChain1
gagguccagcucgucgaguccggcggcggccucguccagcccggcggcucccuccgccucuccugcgccgccuccggcuucaccuucuccaacuacuggauguccuggguccgccaggcccccggcaagggccucgagugggucgccaccaucaagcaggacggcucccagaagaacuacgucgacuccgucaagggccgcuucaccaucucccgcgacaacgccaagaacucccucuaccuccgccucaacucccuccgcgccgaggacaccgccgucuacuacugcgccaccgagcucuucgaccucuggggccgcggcucccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15342 - RNA, 642 nt, Artificial Sequence
  derived and/or modified sequence opt2 from Atinumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15343 - RNA, 1329 nt, Artificial Sequence
  derived and/or modified sequence opt2 from Atlizuab_HeavyChain1
guccagcuccaggaguccggccccggccucguccgccccucccagacccucucccucaccugcaccgucuccggcuacuccaucaccuccgaccacgccugguccuggguccgccagccccccggccgcggccucgaguggaucggcuacaucuccuacuccggcaucaccaccuacaaccccucccucaagucccgcgucacccuccgcgacaccuccaagaaccaguucucccuccgccucuccuccgucaccgccgccgacaccgccgucuacuacugcgcccgcucccucgcccgcaccaccgccgacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15344 - RNA, 639 nt, Artificial Sequence
  derived and/or modified sequence opt2 from Atlizuab_LightChain1
gacauccagacccagucccccuccucccucuccgccuccgucggcgaccgcgucaccaucaccugccgcgccucccaggacaucuccuccuaccucaacugguaccagcagaagcccggcaaggcccccaagcuccucaucuacuacaccucccgccuccacuccggcguccccucccgcuucuccggcuccggcuccggcaccgacuucaccuucaccaucuccucccuccagcccgaggacaucgccaccuacuacugccagcagggcaacacccuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15345 - RNA, 792 nt, Artificial Sequence
  derived and/or modified sequence opt2 from Aurograb_SingleChain
auggccaagguccagcuccuccaguccgccaccgaggucaagaagcccggcgccuccgucaaggucuccugcaaggccuacggcuacaccuucaccgacuacggcaucaccuggguccgccaggcccccggccagggccucgaguggaugggcuggaucuccgccuacaacggcuacaccaacuacgcccagaaguuccaggaccgcaucaccaugaccaccgacgccuccaccuccaccgccuacauggagcuccgcucccuccgccccgacgacaccgccguccucuacugcgcccgcgaccgcgaggacgccucccuccuccgcgacggccacuggggccagggcacccucgucaccgucuccuccggcggcggcggcuccggcggcggcggcuccggcggcggcggcuccggcggcggcggcuccgagaccacccucacccagucccccggcacccucucccucucccccggcgagcgcgccacccucuccugccgcgccucccagaucgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucuccaagcucgagcccgaggacuucgccgucuacuacugccagcacuacggcuccuccucccccuggaccucccgcccccgcgaccaguccgacaucaagcgcgccgccgcccucgagcaccaccaccaccaccac

SEQ ID NO: 15346 - RNA, 1350 nt, Artificial Sequence
  derived and/or modified sequence opt2 from Avelumab_HeavyChain1
gagguccagcuccucgaguccggcggcggccucguccagcccggcggcucccuccgccucuccugcgccgccuccggcuucaccuucuccuccuacaucaugauguggguccgccaggcccccggcaagggccucgagugggucuccuccaucuaccccuccggcggcaucaccuucuacgccgacaccgucaagggccgcuucaccaucucccgcgacaacuccaagaacacccucuaccuccagaugaacucccuccgcgccgaggacaccgccgucuacuacugcgcccgcaucaagcucggcaccgucaccaccgucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15347 - RNA, 648 nt, Artificial Sequence
  derived and/or modified sequence opt2 from Avelumab_LightChain1
caguccgcccucacccagcccgccuccgucuccggcucccccggccaguccaucaccaucuccugcaccggcaccuccuccgacgucggcggcuacaacuacgucuccugguaccagcagcaccccggcaaggcccccaagcucaugaucuacgacgucuccaaccgccccuccggcgucuccaaccgcuucuccggcuccaaguccggcaacaccgccucccucaccaucuccggccuccaggccgaggacgaggccgacuacuacugcuccuccuacaccuccuccuccacccgcgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15348 - RNA, 1344 nt, Artificial Sequence
  derived and/or modified sequence opt2 from Bapineuzumab_HeavyChain1
gagguccagcuccucgaguccggcggcggccucguccagcccggcggcucccuccgccucuccugcgccgccuccggcuucaccuucuccaacuacggcauguccuggguccgccaggcccccggcaagggccucgagugggucgccuccauccgcuccggcggcggccgcaccuacuacuccgacaacgucaagggccgcuucaccaucucccgcgacaacuccaagaacacccucuaccuccagaugaacucccuccgcgccgaggacaccgccgucuacuacugcguccgcuacgaccacuacuccggcuccuccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15349 - RNA, 657 nt, Artificial Sequence
  derived and/or modified sequence opt2 from Bapineuzumab_LightChain1
gacgucgucaugacccaguccccccucucccuccccgucacccccggcgagcccgccuccaucuccugcaaguccucccagucccuccucgacuccgacggcaagaccuaccucaacuggcuccuccagaagcccggccaguccccccagcgccucaucuaccucgucuccaagcucgacuccggcguccccgaccgcuucuccggcuccggcuccggcaccgacuucacccucaagaucucccgcgucgaggccgaggacgucggcgucuacuacugcuggcagggcacccacuucccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15350 - RNA, 1338 nt, Artificial Sequence
  derived and/or modified sequence opt2 from Basiliximab_HeavyChain
cagcuccagcaguccggcaccguccucgcccgccccggcgccuccgucaagauguccugcaaggccuccggcuacuccuucacccgcuacuggaugcacuggaucaagcagcgccccggccagggccucgaguggaucggcgccaucuaccccggcaacuccgacaccuccuacaaccagaaguucgagggcaaggccaagcucaccgccgucaccuccgccuccaccgccuacauggagcucuccucccucacccacgaggacuccgccgucuacuacugcucccgcgacuacggcuacuacuucgacuucuggggccagggcaccacccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagccccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15351 - RNA, 630 nt, Artificial Sequence
  derived and/or modified sequence opt2 from Basiliximab_LightChain
cagaucgucuccacccagucccccgccaucauguccgccucccccggcgagaaggucaccaugaccugcuccgccuccuccucccgcuccuacaugcagugguaccagcagaagcccggcaccucccccaagcgcuggaucuacgacaccuccaagcucgccuccggcguccccgcccgcuucuccggcuccggcuccggcaccuccuacucccucaccaucuccuccauggaggccgaggacgccgccaccuacuacugccaccagcgcuccuccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgag

SEQ ID NO: 15352 - RNA, 1350 nt, Artificial Sequence
  derived and/or modified sequence opt2 from Bavituximab_HeavyChain
gagguccagcuccagcaguccggccccgagcucgagaagcccggcgccuccgucaagcucuccugcaaggccuccggcuacuccuucaccggcuacaacaugaacugggucaagcagucccacggcaagucccucgaguggaucggccacaucgaccccuacuacggcgacaccuccuacaaccagaaguuccgcggcaaggccacccucaccgucgacaaguccuccuccaccgccuacaugcagcucaagucccucaccuccgaggacuccgccgucuacuacugcgucaagggcggcuacuacggccacugguacuucgacgucuggggcgccggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15353 - RNA, 642 nt, Artificial Sequence
  derived and/or modified sequence opt2 from Bavituximab_LightChain
gacauccagaugacccagucccccuccucccucuccgccucccucggcgagcgcgucucccucaccugccgcgccucccaggacaucggcuccucccucaacuggcuccagcagggccccgacggcaccaucaagcgccucaucuacgccaccuccucccucgacuccggcguccccaagcgcuucuccggcucccgcuccggcuccgacuacucccucaccaucuccucccucgaguccgaggacuucgucgacuacuacugccuccaguacgucuccuccccccccaccuucggcgccggcaccaagcucgagcucaagcgcgccgacgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15354 - RNA, 624 nt, Artificial Sequence
  derived and/or modified sequence opt2 from Bavituximab_LightChain_variant_8734_L
gacauccagaugacccagucccccuccucccucuccgccucccucggcgagcgcgucucccucaccugccgcgccucccaggacaucggcuccucccucaacuggcuccagcagggccccgacggcaccaucaagcgccucaucuacgccaccuccucccucgacuccggcguccccaagcgcuucuccggcucccgcuccggcuccgacuacucccucaccaucuccucccucgaguccgaggacuucgucgacuacuacugccuccaguacgucuccuccccccccaccuucggcgccggcaccaagcucgagcucaagcgcgccgacgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccaaggccgacuacgagaagcacaaggucuacgccugcgaggucacccaccagggccucuccucccccgucaccaaguccuucaaccgcggcgagugc

SEQ ID NO: 15355 - RNA, 1368 nt, Artificial Sequence
  derived and/or modified sequence opt2 from Begelomab_HeavyChain1
cagguccagcuccagcaguccggcgccgagcucgucaagcccggcgccuccgucaagcucuccugcaaggccuccggcuacaccuuccgcuccuacgacaucaacuggguccgccagcgccccgagcagggccucgaguggaucggcuggaucuuccccggcgacggcuccaccaaguacaacgagaaguucaagggcaaggccacccucaccaccgacaaguccuccuccaccgccuacaugcagcucucccgccucaccuccgaggacuccgccgucuacuucugcgcccgcuggaccgucgucggccccggcuacuucgacgucuggggcgccggcaccaccgucaccgucuccuccgccaagaccaccccccccuccgucuacccccucgcccccggcugcggcgacaccaccggcuccuccgucacccucggcugccucgucaagggcuacuuccccgaguccgucaccgucaccuggaacuccggcucccucuccuccuccguccacaccuuccccgcccuccuccaguccggccucuacaccauguccuccuccgucaccguccccuccuccaccuggcccucccagaccgucaccugcuccgucgcccaccccgccuccuccaccaccgucgacaagaagcucgagcccuccggccccaucuccaccaucaaccccugcccccccugcaaggagugccacaagugccccgcccccaaccucgagggcggccccuccgucuucaucuucccccccaacaucaaggacguccucaugaucucccucacccccaaggucaccugcgucgucgucgacgucuccgaggacgaccccgacguccagaucuccugguucgucaacaacgucgagguccacaccgcccagacccagacccaccgcgaggacuacaacuccaccauccgcgucgucuccacccuccccauccagcaccaggacuggauguccggcaaggaguucaagugcaaggucaacaacaaggaccuccccucccccaucgagcgcaccaucuccaagaucaagggccucguccgcgccccccaggucuacauccuccccccccccgccgagcagcucucccgcaaggacgucucccucaccugccucgucgucggcuucaaccccggcgacaucuccgucgaguggaccuccaacggccacaccgaggagaacuacaaggacaccgcccccguccucgacuccgacggcuccuacuucaucuacuccaagcucaacaugaagaccuccaagugggagaagaccgacuccuucuccugcaacguccgccacgagggccucaagaacuacuaccucaagaagaccaucucccgcucccccggcaag

SEQ ID NO: 15356 - RNA, 639 nt, Artificial Sequence; identical to SEQ ID NO: 15294
  derived and/or modified sequence opt2 from Begelomab_LightChain1

SEQ ID NO: 15357 - RNA, 1353 nt, Artificial Sequence
  derived and/or modified sequence opt2 from Benralizumab_HeavyChain1
gagguccagcucguccaguccggcgccgaggucaagaagcccggcgccuccgucaaggucuccugcaaggccuccggcuacaccuucaccuccuacgucauccacuggguccgccagcgccccggccagggccucgccuggaugggcuacaucaaccccuacaacgacggcaccaaguacaacgagcgcuucaagggcaaggucaccaucaccuccgaccgcuccaccuccaccgucuacauggagcucuccucccuccgcuccgaggacaccgccgucuaccucugcggccgcgagggcauccgcuacuacggccuccucggcgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15358 - RNA, 642 nt, Artificial Sequence
  derived and/or modified sequence opt2 from Benralizumab_LightChain1
gacauccagaugacccagucccccuccucccucuccgccuccgucggcgaccgcgucaccaucaccugcggcaccuccgaggacaucaucaacuaccucaacugguaccagcagaagcccggcaaggcccccaagcuccucaucuaccacaccucccgccuccaguccggcguccccucccgcuucuccggcuccggcuccggcaccgacuucacccucaccaucuccucccuccagcccgaggacuucgccaccuacuacugccagcagggcuacacccuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15359 - RNA, 1329 nt, Artificial Sequence
  derived and/or modified sequence opt2 from Betalutin_HeavyChain1
gagauccagcuccagcaguccggccccgagcucgucaagcccggcgccuccgucaaggucuccugcaaggccuccggcuacuccuucaccgacuacaacauguacugggucaagcagucccacggcaagucccucgaguggaucggcuacaucgaccccuacaacggcgacaccaccuacaaccagaaguucaagggcaaggccacccucaccgucgacaaguccuccuccaccgccuucauccaccucaacucccucaccuccgaggacuccgccgucuacuacugcgcccgcucccccuacggccacuacgccauggacuacuggggccagggcaccuccgucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucauggacaccgacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 15360 - RNA, 642 nt, Artificial Sequence
  derived and/or modified sequence opt2 from Betalutin_LightChain1
gacaucgucaugacccagucccacaagcuccucuccaccuccgucggcgaccgcgucuccaucaccugcaaggccucccaggacgucuccaccgccgucgacugguaccagcagaagcccggccagucccccaagcuccucaucaacugggccuccacccgccacaccggcguccccgaccgcuucaccggcuccggcuccggcaccgacuacacccucaccaucuccuccaugcaggccgaggaccucgcccucuacuacugccgccagcacuacuccacccccuucaccuucggcuccggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15361 - RNA, 1344 nt, Artificial Sequence
  derived and/or modified sequence opt2 from Bevacituzuab_HeavyChain1
gagguccagcucgucgaguccggcggcggccucguccagcccggcggcucccuccgccucuccugcgccgccuccggcuacaccuucaccaacuacggcaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 15362 - RNA, 639 nt, Artificial Sequence
  derived and/or modified sequence opt2 from Bevacituzuab_LightChain1
gacauccagacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15363 - RNA, 639 nt, Artificial Sequence
  derived and/or modified sequence opt2 from Bevacizumab_154-aspartic_acid_LightChain
gacauccagaugacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgccgaccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgag

SEQ ID NO: 15364 - RNA, 639 nt, Artificial Sequence; identical to SEQ ID NO: 15363
  derived and/or modified sequence opt2 from Bevacizumab_154-substitution_deriv_LightChain

SEQ ID NO: 15365 - RNA, 672 nt, Artificial Sequence
  derived and/or modified sequence opt2 from Bevacizumab_180-serine_HeavyChain
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccgucucccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 15366 - RNA, 672 nt, Artificial Sequence; identical to SEQ ID NO: 15365
  derived and/or modified sequence opt2 from Bevacizumab_180-substitution_deriv_HeavyCahin

SEQ ID NO: 15367 - RNA, 1359 nt, Artificial Sequence
  derived and/or modified sequence opt2 from Bevacizumab_beta_HeavyChain1
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15368 - RNA, 642 nt, Artificial Sequence
  derived and/or modified sequence opt2 from Bevacizumab_beta_LightChain1
gacauccagaugacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15369 - RNA, 687 nt, Artificial Sequence
  derived and/or modified sequence opt2 from Bevacizumab_FcDomain
uccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15370 - RNA, 672 nt, Artificial Sequence
  derived and/or modified sequence opt2 from Bevacizumab_HeavyChain
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 15371 - RNA, 1428 nt, Artificial Sequence
  derived and/or modified sequence opt2 from Bevacizumab_HeavyChain_variant1
gccuccgccaccaugggcugguccugcaucauccucuuccucgucgccaccgccaccggcguccacuccgagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15372 - RNA, 369 nt, Artificial Sequence
  derived and/or modified sequence opt2 from Bevacizumab_HeavyChain_V-Region
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccucc

SEQ ID NO: 15373 - RNA, 717 nt, Artificial Sequence
  derived and/or modified sequence opt2 from Bevacizumab_LightChain1
gccuccaagcucgccaccaugggcugguccugcaucauccucuuccucgucgccaccgccaccggcguccacuccgacauccagaugacccagucccccuccucccucuccgccuccgucggcgaccgcgucaccaucaccugccgcgccucccaggacaucuccuccuaccucaacugguaccagcagaagcccggcaaggcccccaagcuccucaucuacuacaccucccgccuccacuccggcguccccucccgcuucuccggcuccggcuccggcaccgacuucaccuucaccaucuccucccuccagcccgaggacaucgccaccuacuacugccagcagggcaacacccuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15374 - RNA, 711 nt, Artificial Sequence
  derived and/or modified sequence opt2 from Bevacizumab_LightChain2
gccuccgccaccaugggcugguccugcaucauccucuuccucgucgccaccgccaccggcguccacuccgacauccagaugacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15375 - RNA, 642 nt, Artificial Sequence; identical to SEQ ID NO: 15368
  derived and/or modified sequence opt2 from Bevacizumab_LightChain

SEQ ID NO: 15376 - RNA, 324 nt, Artificial Sequence
  derived and/or modified sequence opt2 from Bevacizumab_LightChain_VJ-Region
gacauccagaugacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgc

SEQ ID NO: 15377 - RNA, 321 nt, Artificial Sequence
  derived and/or modified sequence opt2 from Bevacizumab_LightChain_V-Region
gacauccagaugacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaag

SEQ ID NO: 15378 - RNA, 369 nt, Artificial Sequence; identical to SEQ ID NO: 15372
  derived and/or modified sequence opt2 from Bevacizumab-rhuMAb-VEGF_HeavyChain_gamma1-Chain_VDJ-Region

SEQ ID NO: 15379 - RNA, 321 nt, Artificial Sequence; identical to SEQ ID NO: 15377
  derived and/or modified sequence opt2 from Bevacizumab-rhuMAb-VEGF_LightChain_VJ-Region

SEQ ID NO: 15380 - RNA, 1341 nt, Artificial Sequence
  derived and/or modified sequence opt2 from Bevacizumab_gamma1-Chain
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggcucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccuacgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuucaagaagcucaccgucgacaagucccgcuggcagcagggcaacgucuucuccugcuccgucaugcacgaggcccuccacaaccacuacacccagaagucccucucccucucccccggcaag

SEQ ID NO: 15381 - RNA, 1359 nt, Artificial Sequence
  derived and/or modified sequence opt2 from Bevacizumab_gamma1-Chain_CH3-Region_mutein
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucugcacccucccccccucccgcgacgagcucaccaagaaccaggucucccucuccugcgccgucaagggcuucuaccccuccgacaucgccgucgagugggaguccaacggccagcccgagaacaacuacaagaccaccccccccguccucgacuccgacggcuccuucuuccucgucuccaagcucaccgucgacaagucccgcuggcagcagggcaacgucuucuccugcuccgucaugcacgaggcccuccacaaccacuacacccagaagucccucucccucucccccggcaag

SEQ ID NO: 15382 - RNA, 1347 nt, Artificial Sequence; identical to SEQ ID NO: 15295
  derived and/or modified sequence opt2 from Bezlotoxumab_HeavyChain1

SEQ ID NO: 15383 - RNA, 645 nt, Artificial Sequence; identical to SEQ ID NO: 15296
  derived and/or modified sequence opt2 from Bezlotoxumab_LightChain1

SEQ ID NO: 15384 - RNA, 1335 nt, Artificial Sequence
  derived and/or modified sequence opt2 from Bimagrumab_HeavyChain1
cagguccagcucguccaguccggcgccgaggucaagaagcccggcgccuccgucaaggucuccugcaaggccuccggcuacaccuucaccuccuccuacaucaacuggguccgccaggcccccggccagggccucgaguggaugggcaccaucaaccccgucuccggcuccaccuccuacgcccagaaguuccagggccgcgucaccaugacccgcgacaccuccaucuccaccgccuacauggagcucucccgccuccgcuccgacgacaccgccgucuacuacugcgcccgcggcggcugguucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15385 - RNA, 1332 nt, Artificial Sequence
  derived and/or modified sequence opt2 from Bimagrumab_HeavyChain
cagguccagcucguccaguccggcgccgaggucaagaagcccggcgccuccgucaaggucuccugcaaggccuccggcuacaccuucaccuccuccuacaucaacuggguccgccaggcccccggccagggccucgaguggaugggcaccaucaaccccgucuccggcuccaccuccuacgcccagaaguuccagggccgcgucaccaugacccgcgacaccuccaucuccaccgccuacauggagcucucccgccuccgcuccgacgacaccgccgucuacuacugcgcccgcggcggcugguucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15386 - RNA, 651 nt, Artificial Sequence
  derived and/or modified sequence opt2 from Bimagrumab_LightChain1
caguccgcccucacccagcccgccuccgucuccggcucccccggccaguccaucaccaucuccugcaccggcaccuccuccgacgucggcuccuacaacuacgucaacugguaccagcagcaccccggcaaggcccccaagcucaugaucuacggcgucuccaagcgccccuccggcgucuccaaccgcuucuccggcuccaaguccggcaacaccgccucccucaccaucuccggccuccaggccgaggacgaggccgacuacuacugcggcaccuucgccggcggcuccuacuacggcgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15387 - RNA, 1365 nt, Artificial Sequence
  derived and/or modified sequence opt2 from Bimekizumab_HeavyChain1
gagguccagcucgucgaguccggcggcggccucguccagcccggcggcucccuccgccucuccugcgccgccuccggcuucaccuucuccgacuacaacauggccuggguccgccaggcccccggcaagggccucgagugggucgccaccaucaccuacgagggccgcaacaccuacuaccgcgacuccgucaagggccgcuucaccaucucccgcgacaacgccaagaacucccucuaccuccagaugaacucccuccgcgccgaggacaccgccgucuacuacugcgccucccccccccaguacuacgagggcuccaucuaccgccucugguucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15388 - RNA, 642 nt, Artificial Sequence
  derived and/or modified sequence opt2 from Bimekizumab_LightChain1
gccauccagcucacccagucccccuccucccucuccgccuccgucggcgaccgcgucaccaucaccugccgcgccgacgaguccguccgcacccucaugcacugguaccagcagaagcccggcaaggcccccaagcuccucaucuaccucgucuccaacuccgagaucggcguccccgaccgcuucuccggcuccggcuccggcaccgacuuccgccucaccaucuccucccuccagcccgaggacuucgccaccuacuacugccagcagaccugguccgaccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15389 - RNA, 1344 nt, Artificial Sequence
  derived and/or modified sequence opt2 from Bleselumab_HeavyChain1
cagcuccagcuccaggaguccggccccggccuccucaagcccuccgagacccucucccucaccugcaccgucuccggcggcuccaucuccucccccggcuacuacggcggcuggauccgccagccccccggcaagggccucgaguggaucggcuccaucuacaaguccggcuccaccuaccacaaccccucccucaagucccgcgucaccaucuccgucgacaccuccaagaaccaguucucccucaagcucuccuccgucaccgccgccgacaccgccgucuacuacugcacccgccccgucguccgcuacuucggcugguucgaccccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguucgagggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15390 - RNA, 639 nt, Artificial Sequence
  derived and/or modified sequence opt2 from Bleselumab_LightChain1
gccauccagcucacccagucccccuccucccucuccgccuccgucggcgaccgcgucaccaucaccugccgcgccucccagggcaucuccuccgcccucgccugguaccagcagaagcccggcaaggcccccaagcuccucaucuacgacgccuccaaccucgaguccggcguccccucccgcuucuccggcuccggcuccggcaccgacuucacccucaccaucuccucccuccagcccgaggacuucgccaccuacuacugccagcaguucaacuccuaccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15391 - RNA, 1512 nt, Artificial Sequence
  derived and/or modified sequence opt2 from Blinatumomab_HeavyChain1
gacauccagcucacccagucccccgccucccucgccgucucccucggccagcgcgccaccaucuccugcaaggccucccaguccgucgacuacgacggcgacuccuaccucaacugguaccagcagauccccggccagccccccaagcuccucaucuacgacgccuccaaccucgucuccggcauccccccccgcuucuccggcuccggcuccggcaccgacuucacccucaacauccaccccgucgagaaggucgacgccgccaccuaccacugccagcaguccaccgaggaccccuggaccuucggcggcggcaccaagcucgagaucaagggcggcggcggcuccggcggcggcggcuccggcggcggcggcucccagguccagcuccagcaguccggcgccgagcucguccgccccggcuccuccgucaagaucuccugcaaggccuccggcuacgccuucuccuccuacuggaugaacugggucaagcagcgccccggccagggccucgaguggaucggccagaucuggcccggcgacggcgacaccaacuacaacggcaaguucaagggcaaggccacccucaccgccgacgaguccuccuccaccgccuacaugcagcucuccucccucgccuccgaggacuccgccgucuacuucugcgcccgccgcgagaccaccaccgucggccgcuacuacuacgccauggacuacuggggccagggcaccaccgucaccgucuccuccggcggcggcggcuccgacaucaagcuccagcaguccggcgccgagcucgcccgccccggcgccuccgucaagauguccugcaagaccuccggcuacaccuucacccgcuacaccaugcacugggucaagcagcgccccggccagggccucgaguggaucggcuacaucaaccccucccgcggcuacaccaacuacaaccagaaguucaaggacaaggccacccucaccaccgacaaguccuccuccaccgccuacaugcagcucuccucccucaccuccgaggacuccgccgucuacuacugcgcccgcuacuacgacgaccacuacugccucgacuacuggggccagggcaccacccucaccgucuccuccgucgagggcggcuccggcggcuccggcggcuccggcggcuccggcggcgucgacgacauccagcucacccagucccccgccaucauguccgccucccccggcgagaaggucaccaugaccugccgcgccuccuccuccgucuccuacaugaacugguaccagcagaaguccggcaccucccccaagcgcuggaucuacgacaccuccaaggucgccuccggcguccccuaccgcuucuccggcuccggcuccggcaccuccuacucccucaccaucuccuccauggaggccgaggacgccgccaccuacuacugccagcagugguccuccaacccccucaccuucggcgccggcaccaagcucgagcucaagcaccaccaccaccaccac

SEQ ID NO: 15392 - RNA, 1512 nt, Artificial Sequence; identical to SEQ ID NO: 15391
  derived and/or modified sequence opt2 from Blinatumomab_SingleChain

SEQ ID NO: 15393 - RNA, 1512 nt, Artificial Sequence; identical to SEQ ID NO: 15391
  derived and/or modified sequence opt2 from Blinatumumab_SingleChain_variable_fragment_fusion_protein_(bite)

SEQ ID NO: 15394 - RNA, 1344 nt, Artificial Sequence
  derived and/or modified sequence opt2 from Blontuvetmab_HeavyChain
cagguccagcuccagcagucccgcgccgagcucguccgccccggcgccuccgucacccucuccugcaagcccuccggcuacaccuucaccgacuacgagguccacugggucaagcagacccccguccacggccucgaguggaucggcgccaucgaccccgagaccggcggcaccgccgacaaccagaaguucaagggcaaggccauccucaccgccgacaaguccuccuccaccgccuacauggagcuccgcucccucaccuccgaggacuccgccgucuacuacugcaccaacuucgucgacgucuggggcaccggcaccaccgucaccgucuccuccgccuccaccaccgcccccuccgucuucccccucgcccccuccugcggcucccaguccggcuccaccgucgcccucgccugccucgucuccggcuacuuccccgagcccgucaccgucuccuggaacuccggcucccucaccuccggcguccacaccuuccccuccguccuccaguccuccggccucuacucccucuccuccauggucaccguccccuccucccgcuggcccuccgagaccuucaccugcaacgucgcccaccccgccuccaagaccaaggucgacaagcccguccccaagcgcgagaacggccgcgucccccgcccccccgacugccccaagugccccgcccccgagaugcucggcggccccuccgucuucaucuucccccccaagcccaaggacacccuccucaucgcccgcacccccgaggucaccugcgucgucgucgaccucgaccccgaggaccccgagguccagaucuccugguucgucgacggcaagcagaugcagaccgccaagacccagccccgcgaggagcaguucaacggcaccuaccgcgucgucuccguccuccccaucggccaccaggacuggcucaagggcaagcaguucaccugcaaggucaacaacaaggcccuccccucccccaucgagcgcaccaucuccaaggcccgcggccaggcccaccagcccuccgucuacguccucccccccucccgcgaggagcucuccaagaacaccgucucccucaccugccucaucaaggacuucuucccccccgacaucgacgucgaguggcaguccaacggccagcaggagcccgaguccaaguaccgcaccacccccccccagcucgacgaggacggcuccuacuuccucuacuccaagcucuccgucgacaagucccgcuggcagcgcggcgacaccuucaucugcgccgucaugcacgaggcccuccacaaccacuacacccagaagucccucucccacucccccggcaag

SEQ ID NO: 15395 - RNA, 657 nt, Artificial Sequence
  derived and/or modified sequence opt2 from Blontuvetmab_LightChain
gacgucgucaugucccagucccccuccucccucgccgucuccgucggcgagaaggucaccauguccugcaaguccucccagucccuccucuacuccggcaaccagaagaacuaccucgccugguaccagcagaagcccggccaguccccccgccuccucaucuacugggccuccacccgcgaguccggcguccccgaccgcuucaccggcuccggcuccggcaccgacuucacccucaccaucuccuccgucaaggccgaggaccucgccgucuucuacugccagcaguacuacaacuacccccucaccuucggcggcggcacccaccucaccguccucggccagcccaaggccucccccuccgucacccucuucccccccuccuccgaggagcucggcgccaacaaggccacccucgucugccucaucuccgacuucuaccccuccggcgucaccgucgccuggaaggccgacggcucccccaucacccagggcgucgagaccaccaagcccuccaagcaguccaacaacaaguacgccgccuccuccuaccucucccucacccccgacaaguggaagucccacuccuccuucuccugccucgucacccacgagggcuccaccgucgagaagaaggucgcccccgccgagugcucc

SEQ ID NO: 15396 - RNA, 1332 nt, Artificial Sequence
  derived and/or modified sequence opt2 from Blosozumab_HeavyChain1
cagguccagcucguccaguccggcgccgaggucaagaagcccggcgccuccgucaaggucuccugcaaggucuccggcuuccccaucaaggacaccuuccagcacuggguccgccaggcccccggcaagggccucgaguggaugggcugguccgaccccgagaucggcgacaccgaguacgccuccaaguuccagggccgcgucaccaugaccgaggacaccuccaccgacaccgccuacauggagcucuccucccuccgcuccgaggacaccgccgucuacuacugcgccaccggcgacaccaccuacaaguucgacuucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15397 - RNA, 642 nt, Artificial Sequence
  derived and/or modified sequence opt2 from Blosozumab_LightChain1
gacauccagaugacccagucccccuccucccucuccgccuccgucggcgaccgcgucaccaucaccugcaaggccucccaggacguccacaccgccgucgccugguaccagcagaagcccggcaaggcccccaagcuccucaucuacugggccuccacccgcuggaccggcguccccucccgcuucuccggcuccggcuccggcaccgacuucacccucaccaucuccucccuccagcccgaggacuucgccaccuacuacugccagcaguacuccgacuaccccuggaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15398 - RNA, 1332 nt, Artificial Sequence
  derived and/or modified sequence opt2 from Bococizumab_HeavyChain1
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaugggcgagaucucccccuucggcggccgcaccaacuacaacgagaaguucaagucccgcgucaccaugacccgcgacaccuccaccuccaccgucuacauggagcucuccucccuccgcuccgaggacaccgccgucuacuacugcgcccgcgagcgcccccucuacgccuccgaccucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15399 - RNA, 642 nt, Artificial Sequence
  derived and/or modified sequence opt2 from Bococizumab_LightChain1
gacauccagaugacccagucccccuccucccucuccgccuccgucggcgaccgcgucaccaucaccugccgcgccucccagggcaucuccuccgcccucgccugguaccagcagaagcccggcaaggcccccaagcuccucaucuacuccgccuccuaccgcuacaccggcguccccucccgcuucuccggcuccggcuccggcaccgacuucaccuucaccaucuccucccuccagcccgaggacaucgccaccuacuacugccagcagcgcuacucccucuggcgcaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15400 - RNA, 1338 nt, Artificial Sequence
  derived and/or modified sequence opt2 from Brentuximab_vedotin_HeavyChain1
cagauccagcuccagcaguccggccccgaggucgucaagcccggcgccuccgucaagaucuccugcaaggccuccggcuacaccuucaccgacuacuacaucaccugggucaagcagaagcccggccagggccucgaguggaucggcuggaucuaccccggcuccggcaacaccaaguacaacgagaaguucaagggcaaggccacccucaccgucgacaccuccuccuccaccgccuucaugcagcucuccucccucaccuccgaggacaccgccgucuacuucugcgccaacuacggcaacuacugguucgccuacuggggccagggcacccaggucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15401 - RNA, 654 nt, Artificial Sequence
  derived and/or modified sequence opt2 from Brentuximab_vedotin_LightChain1
gacaucguccucacccagucccccgccucccucgccgucucccucggccagcgcgccaccaucuccugcaaggccucccaguccgucgacuucgacggcgacuccuacaugaacugguaccagcagaagcccggccagccccccaagguccucaucuacgccgccuccaaccucgaguccggcauccccgcccgcuucuccggcuccggcuccggcaccgacuucacccucaacauccaccccgucgaggaggaggacgccgccaccuacuacugccagcaguccaacgaggaccccuggaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15402 - RNA, 1335 nt, Artificial Sequence
  derived and/or modified sequence opt2 from Briakinumab_HeavyChain1
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaagaacacccucuaccuccagaugaacucccuccgcgccgaggacaccgccgucuacuacugcaagacccacggcucccacgacaacuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15403 - RNA, 651 nt, Artificial Sequence
  derived and/or modified sequence opt2 from Briakinumab_LightChain1
caguccguccucacccagccccccuccgucuccggcgcccccggccagcgcgucaccaucuccugcuccggcucccgcuccaacaucggcuccaacaccgucaagugguaccagcagcuccccggcaccgcccccaagcuccucaucuacuacaacgaccagcgccccuccggcguccccgaccgcuucuccggcuccaaguccggcaccuccgccucccucgccaucaccggccuccaggccgaggacgaggccgacuacuacugccaguccuacgaccgcuacacccaccccgcccuccucuucggcaccggcaccaaggucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15404 - RNA, 1326 nt, Artificial Sequence
  derived and/or modified sequence opt2 from Brodalumab_HeavyChain1
cagguccagcucguccaguccggcgccgaggucaagaagcccggcgccuccgucaaggucuccugcaaggccuccggcuacaccuucacccgcuacggcaucuccuggguccgccaggcccccggccagggccucgaguggaugggcuggaucuccaccuacuccggcaacaccaacuacgcccagaagcuccagggccgcgucaccaugaccaccgacaccuccaccuccaccgccuacauggagcuccgcucccuccgcuccgacgacaccgccgucuacuacugcgcccgccgccagcucuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15405 - RNA, 642 nt, Artificial Sequence
  derived and/or modified sequence opt2 from Brodalumab_LightChain1
gagaucgucaugacccagucccccgccacccucuccgucucccccggcgagcgcgccacccucuccugccgcgccucccaguccgucuccuccaaccucgccugguuccagcagaagcccggccaggccccccgcccccucaucuacgacgccuccacccgcgccaccggcguccccgcccgcuucuccggcuccggcuccggcaccgacuucacccucaccaucuccucccuccaguccgaggacuucgccgucuacuacugccagcaguacgacaacuggccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15406 - RNA, 756 nt, Artificial Sequence
  derived and/or modified sequence opt2 from Brolucizumab_HeavyChain1
auggagaucgucaugacccagucccccuccacccucuccgccuccgucggcgaccgcgucaucaucaccugccaggccuccgagaucauccacuccuggcucgccugguaccagcagaagcccggcaaggcccccaagcuccucaucuaccucgccuccacccucgccuccggcguccccucccgcuucuccggcuccggcuccggcgccgaguucacccucaccaucuccucccuccagcccgacgacuucgccaccuacuacugccagaacgucuaccucgccuccaccaacggcgccaacuucggccagggcaccaagcucaccguccucggcggcggcggcggcuccggcggcggcggcuccggcggcggcggcuccggcggcggcggcuccgagguccagcucgucgaguccggcggcggccucguccagcccggcggcucccuccgccucuccugcaccgccuccggcuucucccucaccgacuacuacuacaugaccuggguccgccaggcccccggcaagggccucgagugggucggcuucaucgaccccgacgacgaccccuacuacgccaccugggccaagggccgcuucaccaucucccgcgacaacuccaagaacacccucuaccuccagaugaacucccuccgcgccgaggacaccgccgucuacuacugcgccggcggcgaccacaacuccggcuggggccucgacaucuggggccagggcacccucgucaccgucuccucc

SEQ ID NO: 15407 - RNA, 756 nt, Artificial Sequence; identical to SEQ ID NO: 15406
  derived and/or modified sequence opt2 from Brolucizumab_scFv_fragment

SEQ ID NO: 15408 - RNA, 1341 nt, Artificial Sequence
  derived and/or modified sequence opt2 from Brontictuzumab_HeavyChain1
cagguccagcucguccaguccggcgccgaggucaagaagcccggcgccuccgucaagaucuccugcaaggucuccggcuacacccuccgcggcuacuggaucgaguggguccgccaggcccccggcaagggccucgaguggaucggccagauccuccccggcaccggccgcaccaacuacaacgagaaguucaagggccgcgucaccaugaccgccgacaccuccaccgacaccgccuacauggagcucuccucccuccgcuccgaggacaccgccgucuacuacugcgcccgcuucgacggcaacuacggcuacuacgccauggacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15409 - RNA, 645 nt, Artificial Sequence
  derived and/or modified sequence opt2 from Brontictuzumab_LightChain1
caggccgucgucacccaggagcccucccucaccgucucccccggcggcaccgucacccucaccugccgcuccuccaccggcgccgucaccaccuccaacuacgccaacugguuccagcagaagcccggccaggccccccgcacccucaucggcggcaccaacaaccgcgcccccggcguccccgcccgcuucuccggcucccuccucggcggcaaggccgcccucacccucuccggcgcccagcccgaggacgaggccgaguacuacugcgcccucugguacuccaaccacugggucuucggcggcggcaccaagcucaccguccucggccagcccaaggccgcccccuccgucacccucuucccccccuccuccgaggagcuccaggccaacaaggccacccucgucugccucgucuccgacuucuaccccggcgccgucaccgucgccuggaaggccgacggcucccccgucaaggucggcgucgagaccaccaagcccuccaagcaguccaacaacaaguacgccgccuccuccuaccucucccucacccccgagcaguggaagucccaccgcuccuacuccugccgcgucacccacgagggcuccaccgucgagaagaccgucgcccccgccgagugcucc

SEQ ID NO: 15410 - RNA, 1332 nt, Artificial Sequence
  derived and/or modified sequence opt2 from BTT-1023_HeavyChain1
cagguccagcucgucgaguccggcggcggcgucguccagcccggccgcucccuccgccucuccugcgccgccuccggcuucaccuucuucuccuacgccaugcacuggguccgccagacccccggcaagggccucgagugggucgccgucaucugguucgacggcuccaacgagaacuacgucgacuccgucaagggccgcuucaccaucucccgcgacaacuccaagaacacccucuaccuccagaugaacacccuccgcgccgaggacaccgccgucuacuacugcgcccgcgacgccugguccuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguucgccggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15411 - RNA, 642 nt, Artificial Sequence
  derived and/or modified sequence opt2 from BTT-1023_LightChain1
gucauccagcucacccagucccccuccucccucuccgccuccgucggcgaccgcgucaccaucaccugccgcgccucccagggcaucucccgcgcccucgccugguaccagcagaagcccggcaagggccccaagcuccucaucuacgacgccuccucccucgaguccggcguccccucccgcuucuccggcuccggcuccggcaccgacuucacccucaccaucuccucccuccagcccgaggacuucgccaccuacuacugccagcaguucaacuccuacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15412 - RNA, 1341 nt, Artificial Sequence
  derived and/or modified sequence opt2 from Burosumab_HeavyChain1
cagguccagcucguccaguccggcgccgaggucaagaagcccggcgccuccgucaaggucuccugcaaggccuccggcuacaccuucaccaaccacuacaugcacuggguccgccaggcccccggccagggccucgaguggaugggcaucaucaaccccaucuccggcuccaccuccaacgcccagaaguuccagggccgcgucaccaugacccgcgacaccuccaccuccaccgucuacauggagcucuccucccuccgcuccgaggacaccgccgucuacuacugcgcccgcgacaucgucgacgccuucgacuucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15413 - RNA, 639 nt, Artificial Sequence
  derived and/or modified sequence opt2 from Burosumab_LightChain1
gccauccagcucacccagucccccuccucccucuccgccuccgucggcgaccgcgucaccaucaccugccgcgccucccagggcaucuccuccgcccucgucugguaccagcagaagcccggcaaggcccccaagcuccucaucuacgacgccuccucccucgaguccggcguccccucccgcuucuccggcuccggcuccggcaccgacuucacccucaccaucuccucccuccagcccgaggacuucgccaccuacuacugccagcaguucaacgacuacuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15414 - RNA, 1344 nt, Artificial Sequence
  derived and/or modified sequence opt2 from Canakinumab_HeavyChain1
cagguccagcucgucgaguccggcggcggcgucguccagcccggccgcucccuccgccucuccugcgccgccuccggcuucaccuucuccgucuacggcaugaacuggguccgccaggcccccggcaagggccucgagugggucgccaucaucugguacgacggcgacaaccaguacuacgccgacuccgucaagggccgcuucaccaucucccgcgacaacuccaagaacacccucuaccuccagaugaacggccuccgcgccgaggacaccgccgucuacuacugcgcccgcgaccuccgcaccggccccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15415 - RNA, 1344 nt, Artificial Sequence; identical to SEQ ID NO: 15414
  derived and/or modified sequence opt2 from Canakinumab_HeavyChain

SEQ ID NO: 15416 - RNA, 642 nt, Artificial Sequence
  derived and/or modified sequence opt2 from Canakinumab_LightChain1
gagaucguccucacccagucccccgacuuccaguccgucacccccaaggagaaggucaccaucaccugccgcgccucccaguccaucggcuccucccuccacugguaccagcagaagcccgaccagucccccaagcuccucaucaaguacgccucccaguccuucuccggcguccccucccgcuucuccggcuccggcuccggcaccgacuucacccucaccaucaacucccucgaggccgaggacgccgccgccuacuacugccaccaguccuccucccuccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15417 - RNA, 642 nt, Artificial Sequence; identical to SEQ ID NO: 15416
  derived and/or modified sequence opt2 from Canakinumab_LightChain

SEQ ID NO: 15418 - RNA, 1182 nt, Artificial Sequence
  derived and/or modified sequence opt2 from Canakinumab_LightChain_variant_8836_L
cagguccagcucgucgaguccggcggcggcgucguccagcccggccgcucccuccgccucuccugcgccgccuccggcuucaccuucuccgucuacggcaugaacuggguccgccaggcccccggcaagggccucgagugggucgccaucaucugguacgacggcgacaaccaguacuacgccgacuccgucaagggccgcuucaccaucucccgcgacaacuccaagaacacccucuaccuccagaugaacggccuccgcgccgaggacaccgccgucuacuacugcgcccgcgaccuccgcaccggccccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucgagaucguccucacccagucccccgacuuccaguccgucacccccaaggagaaggucaccaucaccugccgcgccucccaguccaucggcuccucccuccacugguaccagcagaagcccgaccagucccccaagcuccucaucaaguacgccucccaguccuucuccggcguccccucccgcuucuccggcuccggcuccggcaccgacuucacccucaccaucaacucccucgaggccgaggacgccgccgccuacuacugccaccaguccuccucccuccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15419 - RNA, 1197 nt, Artificial Sequence
  derived and/or modified sequence opt2 from Cantuzumab_HeavyChain1
aucgacaccaccaccggcgagcccaccuacgcccagaaguuccagggccgcaucgccuucucccucgagaccuccgccuccaccgccuaccuccagaucaagucccucaaguccgaggacaccgccaccuacuucugcgcccgccgcggccccuacaacugguacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15420 - RNA, 1347 nt, Artificial Sequence
  derived and/or modified sequence opt2 from Cantuzumab_HeavyChain
cagguccagcucguccaguccggcgccgaggucaagaagcccggcgagaccgucaagaucuccugcaaggccuccgacuacaccuucaccuacuacggcaugaacugggucaagcaggcccccggccagggccucaaguggaugggcuggaucgacaccaccaccggcgagcccaccuacgcccagaaguuccagggccgcaucgccuucucccucgagaccuccgccuccaccgccuaccuccagaucaagucccucaaguccgaggacaccgccaccuacuucugcgcccgccgcggccccuacaacugguacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15421 - RNA, 657 nt, Artificial Sequence
  derived and/or modified sequence opt2 from Cantuzumab_LightChain1
gacaucgucaugacccaguccccccucuccguccccgucacccccggcgagcccgucuccaucuccugccgcuccuccaagucccuccuccacuccaacggcaacaccuaccucuacugguuccuccagcgccccggccaguccccccagcuccucaucuaccgcauguccaaccucgucuccggcguccccgaccgcuucuccggcuccggcuccggcaccgccuucacccuccgcaucucccgcgucgaggccgaggacgucggcgucuacuacugccuccagcaccucgaguaccccuucaccuucggccccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15422 - RNA, 1344 nt, Artificial Sequence
  derived and/or modified sequence opt2 from Cantuzumab_mertansine_HeavyChain1
guccagcucguccaguccggcgccgaggucaagaagcccggcgagaccgucaagaucuccugcaaggccuccgacuacaccuucaccuacuacggcaugaacugggucaagcaggcccccggccagggccucaaguggaugggcuggaucgacaccaccaccggcgagcccaccuacgcccagaaguuccagggccgcaucgccuucucccucgagaccuccgccuccaccgccuaccuccagaucaagucccucaaguccgaggacaccgccaccuacuucugcgcccgccgcggccccuacaacugguacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15423 - RNA, 657 nt, Artificial Sequence; identical to SEQ ID NO: 15421
  derived and/or modified sequence opt2 from Cantuzumab_mertansine_LightChain1

SEQ ID NO: 15424 - RNA, 1347 nt, Artificial Sequence; identical to SEQ ID NO: 15420
  derived and/or modified sequence opt2 from Cantuzumab_ravtansine_HeavyChain1

SEQ ID NO: 15425 - RNA, 657 nt, Artificial Sequence; identical to SEQ ID NO: 15421
  derived and/or modified sequence opt2 from Cantuzumab_ravtansine_LightChain1

SEQ ID NO: 15426 - RNA, 777 nt, Artificial Sequence
  derived and/or modified sequence opt2 from Caplacizumab
gagguccagcucgucgaguccggcggcggccucguccagcccggcggcucccuccgccucuccugcgccgccuccggccgcaccuucuccuacaaccccaugggcugguuccgccaggcccccggcaagggccgcgagcucgucgccgccaucucccgcaccggcggcuccaccuacuaccccgacuccgucgagggccgcuucaccaucucccgcgacaacgccaagcgcauggucuaccuccagaugaacucccuccgcgccgaggacaccgccgucuacuacugcgccgccgccggcguccgcgccgaggacggccgcguccgcacccuccccuccgaguacaccuucuggggccagggcacccaggucaccgucuccuccgccgccgccgagguccagcucgucgaguccggcggcggccucguccagcccggcggcucccuccgccucuccugcgccgccuccggccgcaccuucuccuacaaccccaugggcugguuccgccaggcccccggcaagggccgcgagcucgucgccgccaucucccgcaccggcggcuccaccuacuaccccgacuccgucgagggccgcuucaccaucucccgcgacaacgccaagcgcauggucuaccuccagaugaacucccuccgcgccgaggacaccgccgucuacuacugcgccgccgccggcguccgcgccgaggacggccgcguccgcacccuccccuccgaguacaccuucuggggccagggcacccaggucaccgucuccucc

SEQ ID NO: 15427 - RNA, 777 nt, Artificial Sequence; identical to SEQ ID NO: 15426
  derived and/or modified sequence opt2 from Caplacizumab_HeavyChain1

SEQ ID NO: 15428 - RNA, 777 nt, Artificial Sequence; identical to SEQ ID NO: 15426
  derived and/or modified sequence opt2 from Caplacizumab_HeavyChain1

SEQ ID NO: 15429 - RNA, 1347 nt, Artificial Sequence
  derived and/or modified sequence opt2 from Carlumab_HeavyChain1
cagguccagcucguccaguccggcgccgaggucaagaagcccggcuccuccgucaaggucuccugcaaggccuccggcggcaccuucuccuccuacggcaucuccuggguccgccaggcccccggccagggccucgaguggaugggcggcaucauccccaucuucggcaccgccaacuacgcccagaaguuccagggccgcgucaccaucaccgccgacgaguccaccuccaccgccuacauggagcucuccucccuccgcuccgaggacaccgccgucuacuacugcgcccgcuacgacggcaucuacggcgagcucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15430 - RNA, 648 nt, Artificial Sequence
  derived and/or modified sequence opt2 from Carlumab_LightChain1
gagaucguccucacccagucccccgccacccucucccucucccccggcgagcgcgccacccucuccugccgcgccucccaguccgucuccgacgccuaccucgccugguaccagcagaagcccggccaggccccccgccuccucaucuacgacgccuccucccgcgccaccggcguccccgcccgcuucuccggcuccggcuccggcaccgacuucacccucaccaucuccucccucgagcccgaggacuucgccgucuacuacugccaccaguacauccagcuccacuccuucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15431 - RNA, 1353 nt, Artificial Sequence
  derived and/or modified sequence opt2 from Cergutuzumab_amunaleukin_HeavyChain1
cagguccagcucguccaguccggcgccgaggucaagaagcccggcgccuccgucaaggucuccugcaaggccuccggcuacaccuucaccgaguucggcaugaacuggguccgccaggcccccggccagggccucgaguggaugggcuggaucaacaccaagaccggcgaggccaccuacgucgaggaguucaagggccgcgucaccuucaccaccgacaccuccaccuccaccgccuacauggagcuccgcucccuccgcuccgacgacaccgccgucuacuacugcgcccgcugggacuucgccuacuacgucgaggccauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccucggcgcccccaucgagaagaccaucuccaaggccaagggccagccccgcgagccccaggucugcacccucccccccucccgcgacgagcucaccaagaaccaggucucccucuccugcgccgucaagggcuucuaccccuccgacaucgccgucgagugggaguccaacggccagcccgagaacaacuacaagaccaccccccccguccucgacuccgacggcuccuucuuccucgucuccaagcucaccgucgacaagucccgcuggcagcagggcaacgucuucuccugcuccgucaugcacgaggcccuccacaaccacuacacccagaagucccucucccucucccccggcaag

SEQ ID NO: 15432 - RNA, 1794 nt, Artificial Sequence
  derived and/or modified sequence opt2 from Cergutuzumab_amunaleukin_HeavyChain2
cagguccagcucguccaguccggcgccgaggucaagaagcccggcgccuccgucaaggucuccugcaaggccuccggcuacaccuucaccgaguucggcaugaacuggguccgccaggcccccggccagggccucgaguggaugggcuggaucaacaccaagaccggcgaggccaccuacgucgaggaguucaagggccgcgucaccuucaccaccgacaccuccaccuccaccgccuacauggagcuccgcucccuccgcuccgacgacaccgccgucuacuacugcgcccgcugggacuucgccuacuacgucgaggccauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccucggcgcccccaucgagaagaccaucuccaaggccaagggccagccccgcgagccccaggucuacacccucccccccugccgcgacgagcucaccaagaaccaggucucccucuggugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcggcggcggcggcuccggcggcggcggcuccggcggcggcggcuccgcccccgccuccuccuccaccaagaagacccagcuccagcucgagcaccuccuccucgaccuccagaugauccucaacggcaucaacaacuacaagaaccccaagcucacccgcaugcucaccgccaaguucgccaugcccaagaaggccaccgagcucaagcaccuccagugccucgaggaggagcucaagccccucgaggagguccucaacggcgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucgcccaguccaucaucuccacccucacc

SEQ ID NO: 15433 - RNA, 645 nt, Artificial Sequence
  derived and/or modified sequence opt2 from Cergutuzumab_amunaleukin_LightChain1
gacauccagaugacccagucccccuccucccucuccgccuccgucggcgaccgcgucaccaucaccugcaaggccuccgccgccgucggcaccuacgucgccugguaccagcagaagcccggcaaggcccccaagcuccucaucuacuccgccuccuaccgcaagcgcggcguccccucccgcuucuccggcuccggcuccggcaccgacuucacccucaccaucuccucccuccagcccgaggacuucgccaccuacuacugccaccaguacuacaccuacccccucuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15434 - RNA, 687 nt, Artificial Sequence
  derived and/or modified sequence opt2 from Certolizumab_pegol_HeavyChain1
gagguccagcucgucgaguccggcggcggccucguccagcccggcggcucccuccgccucuccugcgccgccuccggcuacgucuucaccgacuacggcaugaacuggguccgccaggcccccggcaagggccucgaguggaugggcuggaucaacaccuacaucggcgagcccaucuacgccgacuccgucaagggccgcuucaccuucucccucgacaccuccaaguccaccgccuaccuccagaugaacucccuccgcgccgaggacaccgccgucuacuacugcgcccgcggcuaccgcuccuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcgccgcc

SEQ ID NO: 15435 - RNA, 687 nt, Artificial Sequence; identical to SEQ ID NO: 15434
  derived and/or modified sequence opt2 from Certolizumab_pegol_HeavyChain

SEQ ID NO: 15436 - RNA, 642 nt, Artificial Sequence
  derived and/or modified sequence opt2 from Certolizumab_pegol_LightChain1
gacauccagaugacccagucccccuccucccucuccgccuccgucggcgaccgcgucaccaucaccugcaaggccucccagaacgucggcaccaacgucgccugguaccagcagaagcccggcaaggcccccaaggcccucaucuacuccgccuccuuccucuacuccggcguccccuaccgcuucuccggcuccggcuccggcaccgacuucacccucaccaucuccucccuccagcccgaggacuucgccaccuacuacugccagcaguacaacaucuacccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15437 - RNA, 642 nt, Artificial Sequence; identical to SEQ ID NO: 15436
  derived and/or modified sequence opt2 from Certolizumab_pegol_LightChain

SEQ ID NO: 15438 - RNA, 1356 nt, Artificial Sequence
  derived and/or modified sequence opt2 from Cetuximab_HeavyChain
cagguccagcucaagcaguccggccccggccucguccagcccucccagucccucuccaucaccugcaccgucuccggcuucucccucaccaacuacggcguccacuggguccgccagucccccggcaagggccucgaguggcucggcgucaucugguccggcggcaacaccgacuacaacacccccuucaccucccgccucuccaucaacaaggacaacuccaagucccaggucuucuucaagaugaacucccuccaguccaacgacaccgccaucuacuacugcgcccgcgcccucaccuacuacgacuacgaguucgccuacuggggccagggcacccucgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaagucccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15439 - RNA, 1347 nt, Artificial Sequence
  derived and/or modified sequence opt2 from Cetuximab_HeavyChain_variant
cagguccagcucaagcaguccggccccggccucguccagcccucccagucccucuccaucaccugcaccgucuccggcuucucccucaccaacuacggcguccacuggguccgccagucccccggcaagggccucgaguggcucggcgucaucugguccggcggcaacaccgacuacaacacccccuucaccucccgccucuccaucaacaaggacaacuccaagucccaggucuucuucaagaugaacucccuccaguccaacgacaccgccaucuacuacugcgcccgcgcccucaccuacuacgacuacgaguucgccuacuggggccagggcacccucgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15440 - RNA, 639 nt, Artificial Sequence
  derived and/or modified sequence opt2 from Cetuximab_LightChain
gacauccuccucacccagucccccgucauccucuccgucucccccggcgagcgcgucuccuucuccugccgcgccucccaguccaucggcaccaacauccacugguaccagcagcgcaccaacggcuccccccgccuccucaucaaguacgccuccgaguccaucuccggcauccccucccgcuucuccggcuccggcuccggcaccgacuucacccucuccaucaacuccgucgaguccgaggacaucgccgacuacuacugccagcagaacaacaacuggcccaccaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgcc

SEQ ID NO: 15441 - RNA, 642 nt, Artificial Sequence
  derived and/or modified sequence opt2 from Cetuximab_LightChain_variant
gacauccuccucacccagucccccgucauccucuccgucucccccggcgagcgcgucuccuucuccugccgcgccucccaguccaucggcaccaacauccacugguaccagcagcgcaccaacggcuccccccgccuccucaucaaguacgccuccgaguccaucuccggcauccccucccgcuucuccggcuccggcuccggcaccgacuucacccucuccaucaacuccgucgaguccgaggacaucgccgacuacuacugccagcagaacaacaacuggcccaccaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15442 - RNA, 675 nt, Artificial Sequence
  derived and/or modified sequence opt2 from Citatuzumab_bogatox_HeavyChain1
caccaccaccaccaccacgagguccagcucguccaguccggccccggccucguccagcccggcggcuccguccgcaucuccugcgccgccuccggcuacaccuucaccaacuacggcaugaacugggucaagcaggcccccggcaagggccucgaguggaugggcuggaucaacaccuacaccggcgaguccaccuacgccgacuccuucaagggccgcuucaccuucucccucgacaccuccgccuccgccgccuaccuccagaucaacucccuccgcgccgaggacaccgccgucuacuacugcgcccgcuucgccaucaagggcgacuacuggggccagggcacccuccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 15443 - RNA, 1443 nt, Artificial Sequence
  derived and/or modified sequence opt2 from Citatuzumab_bogatox_LightChain1
gacauccagaugacccagucccccuccucccucuccgccuccgucggcgaccgcgucaccaucaccugccgcuccaccaagucccuccuccacuccaacggcaucaccuaccucuacugguaccagcagaagcccggcaaggcccccaagcuccucaucuaccagauguccaaccucgccuccggcguccccucccgcuucuccuccuccggcuccggcaccgacuucacccucaccaucuccucccuccagcccgaggacuucgccaccuacuacugcgcccagaaccucgagaucccccgcaccuucggccagggcaccaaggucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugcacccgccaccgccagccccgcggcugggagcagcucuacaacaccgucuccuucaaccucggcgaggccuacgaguaccccaccuucauccaggaccuccgcaacgagcucgccaagggcacccccgucugccagcuccccgucacccuccagaccaucgccgacgacaagcgcuucguccucgucgacaucaccaccaccuccaagaagaccgucaaggucgccaucgacgucaccgacgucuacgucgucggcuaccaggacaagugggacggcaaggaccgcgccgucuuccucgacaagguccccaccgucgccaccuccaagcucuuccccggcgucaccaaccgcgucacccucaccuucgacggcuccuaccagaagcucgucaacgccgccaaggccgaccgcaaggcccucgagcucggcgucaacaagcucgaguucuccaucgaggccauccacggcaagaccaucaacggccaggaggccgccaaguucuuccucaucgucauccagauggucuccgaggccgcccgcuucaaguacaucgagaccgaggucgucgaccgcggccucuacggcuccuucaagcccaacuucaagguccucaaccucgagaacaacuggggcgacaucuccgacgccauccacaaguccuccccccagugcaccaccaucaaccccgcccuccagcucaucucccccuccaacgaccccugggucgucaacaaggucucccagaucucccccgacaugggcauccucaaguucaaguccuccaag

SEQ ID NO: 15444 - RNA, 1380 nt, Artificial Sequence
  derived and/or modified sequence opt2 from Cixutumumab_HeavyChain1
gagguccagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucauccccaucuucggcaccgccaacuacgcccagaaguuccagggccgcgucaccaucaccgccgacaaguccaccuccaccgccuacauggagcucuccucccuccgcuccgaggacaccgccgucuacuacugcgcccgcgccccccuccgcuuccucgagugguccacccaggaccacuacuacuacuacuacauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15445 - RNA, 642 nt, Artificial Sequence
  derived and/or modified sequence opt2 from Cixutumumab_LightChain1
uccuccgagcucacccaggaccccgccgucuccgucgcccucggccagaccguccgcaucaccugccagggcgacucccuccgcuccuacuacgccaccugguaccagcagaagcccggccaggcccccauccucgucaucuacggcgagaacaagcgccccuccggcauccccgaccgcuucuccggcuccuccuccggcaacaccgccucccucaccaucaccggcgcccaggccgaggacgaggccgacuacuacugcaagucccgcgacggcuccggccagcaccucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccgccgagugcucc

SEQ ID NO: 15446 - RNA, 1350 nt, Artificial Sequence
  derived and/or modified sequence opt2 from Clazakizumab_HeavyChain1
gagguccagcucgucgaguccggcggcggccucguccagcccggcggcucccuccgccucuccugcgccgccuccggcuucucccucuccaacuacuacgucaccuggguccgccaggcccccggcaagggccucgagugggucggcaucaucuacggcuccgacgagaccgccuacgccaccuccgccaucggccgcuucaccaucucccgcgacaacuccaagaacacccucuaccuccagaugaacucccuccgcgccgaggacaccgccgucuacuacugcgcccgcgacgacuccuccgacugggacgccaaguucaaccucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15447 - RNA, 651 nt, Artificial Sequence
  derived and/or modified sequence opt2 from Clazakizumab_LightChain1
gccauccagaugacccagucccccuccucccucuccgccuccgucggcgaccgcgucaccaucaccugccaggccucccaguccaucaacaacgagcucuccugguaccagcagaagcccggcaaggcccccaagcuccucaucuaccgcgccuccacccucgccuccggcguccccucccgcuucuccggcuccggcuccggcaccgacuucacccucaccaucuccucccuccagcccgacgacuucgccaccuacuacugccagcagggcuacucccuccgcaacaucgacaacgccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15448 - RNA, 1347 nt, Artificial Sequence
  derived and/or modified sequence opt2 from Clivatuzumab_tetraxetan_HeavyChain1
cagguccagcuccagcaguccggcgccgaggucaagaagcccggcgccuccgucaaggucuccugcgaggccuccggcuacaccuuccccuccuacguccuccacugggucaagcaggcccccggccagggccucgaguggaucggcuacaucaaccccuacaacgacggcacccaguacaacgagaaguucaagggcaaggccacccucacccgcgacaccuccaucaacaccgccuacauggagcucucccgccuccgcuccgacgacaccgccgucuacuacugcgcccgcggcuucggcggcuccuacggcuucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15449 - RNA, 645 nt, Artificial Sequence
  derived and/or modified sequence opt2 from Clivatuzumab_tetraxetan_LightChain1
gacauccagcucacccagucccccuccucccucuccgccuccgucggcgaccgcgucaccaugaccugcuccgccuccuccuccgucuccuccuccuaccucuacugguaccagcagaagcccggcaaggcccccaagcucuggaucuacuccaccuccaaccucgccuccggcguccccgcccgcuucuccggcuccggcuccggcaccgacuucacccucaccaucuccucccuccagcccgaggacuccgccuccuacuucugccaccaguggaaccgcuaccccuacaccuucggcggcggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15450 - RNA, 1335 nt, Artificial Sequence
  derived and/or modified sequence opt2 from Codrituzumab_HeavyChain1
cagguccagcucguccaguccggcgccgaggucaagaagcccggcgccuccgucaaggucuccugcaaggccuccggcuacaccuucaccgacuacgagaugcacuggguccgccaggcccccggccagggccucgaguggaugggcgcccucgaccccaagaccggcgacaccgccuacucccagaaguucaagggccgcgucacccucaccgccgacaaguccaccuccaccgccuacauggagcucuccucccucaccuccgaggacaccgccgucuacuacugcacccgcuucuacuccuacaccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15451 - RNA, 657 nt, Artificial Sequence
  derived and/or modified sequence opt2 from Codrituzumab_LightChain1
gacgucgucaugacccaguccccccucucccuccccgucacccccggcgagcccgccuccaucuccugccgcuccucccagucccucguccacuccaaccgcaacaccuaccuccacugguaccuccagaagcccggccaguccccccagcuccucaucuacaaggucuccaaccgcuucuccggcguccccgaccgcuucuccggcuccggcuccggcaccgacuucacccucaagaucucccgcgucgaggccgaggacgucggcgucuacuacugcucccagaacacccacgucccccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15452 - RNA, 1350 nt, Artificial Sequence
  derived and/or modified sequence opt2 from Coltuximab_ravtansine_HeavyChain1
cagguccagcucguccagcccggcgccgaggucgucaagcccggcgccuccgucaagcucuccugcaagaccuccggcuacaccuucaccuccaacuggaugcacugggucaagcaggcccccggccagggccucgaguggaucggcgagaucgaccccuccgacuccuacaccaacuacaaccagaacuuccagggcaaggccaagcucaccgucgacaaguccaccuccaccgccuacauggaggucuccucccuccgcuccgacgacaccgccgucuacuacugcgcccgcggcuccaaccccuacuacuacgccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15453 - RNA, 633 nt, Artificial Sequence
  derived and/or modified sequence opt2 from Coltuximab_ravtansine_LightChain1
gagaucguccucacccagucccccgccaucauguccgccucccccggcgagcgcgucaccaugaccugcuccgccuccuccggcgucaacuacaugcacugguaccagcagaagcccggcaccuccccccgccgcuggaucuacgacaccuccaagcucgccuccggcguccccgcccgcuucuccggcuccggcuccggcaccgacuacucccucaccaucuccuccauggagcccgaggacgccgccaccuacuacugccaccagcgcggcuccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15454 - RNA, 1356 nt, Artificial Sequence
  derived and/or modified sequence opt2 from Conatumumab_CV_HeavyChain
cagguccagcuccaggaguccggccccggccucgucaagcccucccagacccucucccucaccugcaccgucuccggcggcuccaucuccuccggcgacuacuucugguccuggauccgccagcuccccggcaagggccucgaguggaucggccacauccacaacuccggcaccaccuacuacaaccccucccucaagucccgcgucaccaucuccgucgacaccuccaagaagcaguucucccuccgccucuccuccgucaccgccgccgacaccgccgucuacuacugcgcccgcgaccgcggcggcgacuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15455 - RNA, 645 nt, Artificial Sequence
  derived and/or modified sequence opt2 from Conatumumab_CV_LightChain
gagaucguccucacccagucccccggcacccucucccucucccccggcgagcgcgccacccucuccugccgcgccucccagggcaucucccgcuccuaccucgccugguaccagcagaagcccggccaggcccccucccuccucaucuacggcgccuccucccgcgccaccggcauccccgaccgcuucuccggcuccggcuccggcaccgacuucacccucaccaucucccgccucgagcccgaggacuucgccgucuacuacugccagcaguucggcuccucccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15456 - RNA, 1356 nt, Artificial Sequence; identical to SEQ ID NO: 15454
  derived and/or modified sequence opt2 from Conatumumab_HeavyChain1

SEQ ID NO: 15457 - RNA, 1356 nt, Artificial Sequence; identical to SEQ ID NO: 15454
  derived and/or modified sequence opt2 from Conatumumab_HeavyChain

SEQ ID NO: 15458 - RNA, 645 nt, Artificial Sequence; identical to SEQ ID NO: 15455
  derived and/or modified sequence opt2 from Conatumumab_LightChain1

SEQ ID NO: 15459 - RNA, 645 nt, Artificial Sequence; identical to SEQ ID NO: 15455
  derived and/or modified sequence opt2 from Conatumumab_LightChain

SEQ ID NO: 15460 - RNA, 1344 nt, Artificial Sequence
  derived and/or modified sequence opt2 from Concizumab_HeavyChain1
gagguccagcucgucgaguccggcggcggccucgucaagcccggcggcucccuccgccucuccugcgccgccuccggcuucaccuucuccaacuacgccauguccuggguccgccagacccccgagaagcgccucgagugggucgccaccaucucccgcuccggcuccuacuccuacuuccccgacuccguccagggccgcuucaccaucucccgcgacaacgccaagaacucccucuaccuccagaugaacucccuccgcgccgaggacaccgccgucuacuacugcgcccgccucggcggcuacgacgagggcgacgccauggacuccuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15461 - RNA, 657 nt, Artificial Sequence
  derived and/or modified sequence opt2 from Concizumab_LightChain1
gacaucgucaugacccagaccccccucucccucuccgucacccccggccagcccgccuccaucuccugcaaguccucccagucccuccucgaguccgacggcaagaccuaccucaacugguaccuccagaagcccggccaguccccccagcuccucaucuaccucgucuccauccucgacuccggcguccccgaccgcuucuccggcuccggcuccggcaccgacuucacccucaagaucucccgcgucgaggccgaggacgucggcgucuacuacugccuccaggccacccacuucccccagaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15462 - RNA, 1314 nt, Artificial Sequence
  derived and/or modified sequence opt2 from Crenezumab_HeavyChain1
gagguccagcucgucgaguccggcggcggccucguccagcccggcggcucccuccgccucuccugcgccgccuccggcuucaccuucuccuccuacggcauguccuggguccgccaggcccccggcaagggccucgagcucgucgccuccaucaacuccaacggcggcuccaccuacuaccccgacuccgucaagggccgcuucaccaucucccgcgacaacgccaagaacucccucuaccuccagaugaacucccuccgcgccgaggacaccgccgucuacuacugcgccuccggcgacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15463 - RNA, 657 nt, Artificial Sequence
  derived and/or modified sequence opt2 from Crenezumab_LightChain1
gacaucgucaugacccaguccccccucucccuccccgucacccccggcgagcccgccuccaucuccugccgcuccucccagucccucgucuacuccaacggcgacaccuaccuccacugguaccuccagaagcccggccaguccccccagcuccucaucuacaaggucuccaaccgcuucuccggcguccccgaccgcuucuccggcuccggcuccggcaccgacuucacccucaagaucucccgcgucgaggccgaggacgucggcgucuacuacugcucccaguccacccacguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15464 - RNA, 1365 nt, Artificial Sequence
  derived and/or modified sequence opt2 from Crotedumab_HeavyChain1
gagguccagcucgucgaguccggcggcggccucguccagcccggcggcucccuccgccucuccugcgccgccuccggcuucaccuucuccaacuaccucaugaacuggguccgccaggcccccggcaagggccucgaguggcucgccaacauccaggaggacggcaucgagaaguacuacgucgacuccgucaagggccgcuucaccaucucccgcgacaacgccaagaacucccucuaccuccagaugaacucccuccgcgccgaggacaccgccgucuacuacugcgcccgcgagcccucccacuacgacauccucaccggcuacgacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccaacaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15465 - RNA, 1365 nt, Artificial Sequence
  derived and/or modified sequence opt2 from Crotedumab_HeavyChain2
gagguccagcucgucgaguccggcggcggccucguccagcccggcggcucccuccaccucuccugcgccgccuccggcuucaccuucuccaacuaccucaugaacuggguccgccaggcccccggcaagggccucgaguggcucgccaacauccaggaggacggcaucgagaaguacuacgucgacuccgucaagggccgcuucaccaucucccgcgacaacgccaagaacucccucuaccuccagaugaacucccuccgcgccgaggacaccgccgucuacuacugcgcccgcgagcccucccacuacgacauccucaccggcuacgacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccaacaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccgaggucgacgagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucugguccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacgagucccgcuggcaggagcacaacgucuucuccugcuccgucaugcacgaggcccuccacaaccacuacacccagaagucccucucccucucccucggcaag

SEQ ID NO: 15466 - RNA, 642 nt, Artificial Sequence
  derived and/or modified sequence opt2 from Crotedumab_LightChain1
gacauccagaugacccagucccccuccucccucuccgccuccgucggcgaccgcgucaccaucaccugccgcgccucccagggcauccgcaacgaccucggcugguaccagcagaagcccggcaaggcccccaagcgccucaucuacgccgccuccucccuccaguccggcguccccucccgcuucuccggcuccggcuccggcaccgaguucauccucaccgucuccucccuccagcccgaggacuucgccaccuacuacugccuccaguacaacgagaaccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgaggagcacaaggucuacgccugcgaggucacccaccagggccucuccucccccgucaccaaguccuucaaccgcggcgagugc

SEQ ID NO: 15467 - RNA, 642 nt, Artificial Sequence
  derived and/or modified sequence opt2 from Crotedumab_LightChain2
gacauccagaugacccagucccccuccucccucuccgccuccgucggcgaccgcgucaccaucaccugccgcgccucccagggcauccgcaacgaccucggcugguaccagcagaagcccggcaaggcccccaagcgccucaucuacgccgccuccucccuccaguccggcguccccucccgcuucuccggcuccggcuccggcaccgaguucauccucaccgucuccucccuccagcccgaggacuucgccaccuacuacugccuccaguacaacuccaaccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccagaacaaggucgacaacgcccuccaguccggcaacucccaggaguccgucaccgagcaggacuccaaggacuccaccuacucccucuccuccacccucacccucuccgaggccgacuacgagaagcacaaggucuacgccugcgaggucacccaccagggccucuccucccccgucaccaaguccuucaaccgcggcgagugc

SEQ ID NO: 15468 - RNA, 1332 nt, Artificial Sequence
  derived and/or modified sequence opt2 from Dacetuzumab_HeavyChain1
gagguccagcucgucgaguccggcggcggccucguccagcccggcggcucccuccgccucuccugcgccgccuccggcuacuccuucaccggcuacuacauccacuggguccgccaggcccccggcaagggccucgagugggucgcccgcgucauccccaacgccggcggcaccuccuacaaccagaaguucaagggccgcuucacccucuccgucgacaacuccaagaacaccgccuaccuccagaugaacucccuccgcgccgaggacaccgccgucuacuacugcgcccgcgagggcaucuacugguggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15469 - RNA, 657 nt, Artificial Sequence
  derived and/or modified sequence opt2 from Dacetuzumab_LightChain1
gacauccagaugacccagucccccuccucccucuccgccuccgucggcgaccgcgucaccaucaccugccgcuccucccagucccucguccacuccaacggcaacaccuuccuccacugguaccagcagaagcccggcaaggcccccaagcuccucaucuacaccgucuccaaccgcuucuccggcguccccucccgcuucuccggcuccggcuccggcaccgacuucacccucaccaucuccucccuccagcccgaggacuucgccaccuacuucugcucccagaccacccacguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15470 - RNA, 318 nt, Artificial Sequence
  derived and/or modified sequence opt2 from Dacliximab_LightChain_VJ-Region
gacauccagaugacccagucccccuccacccucuccgccuccgucggcgaccgcgucaccaucaccugcuccgccuccuccuccaucuccuacaugcacugguaccagcagaagcccggcaaggcccccaagcuccucaucuacaccaccuccaaccucgccuccggcguccccgcccgcuucuccggcuccggcuccggcaccgaguucacccucaccaucuccucccuccagcccgacgacuucgccaccuacuacugccaccagcgcuccaccuacccccucaccuucggccagggcaccaaggucgaggucaag

SEQ ID NO: 15471 - RNA, 348 nt, Artificial Sequence
  derived and/or modified sequence opt2 from Dacliximab_gamma2-Chain_VDJ-Region
cagguccagcucguccaguccggcgccgaggucaagaagcccggcuccuccgucaaggucuccugcaaggccuccggcuacaccuucaccuccuaccgcaugcacuggguccgccaggcccccggccagggccucgaguggaucggcuacaucaaccccuccaccggcuacaccgaguacaaccagaaguucaaggacaaggccaccaucaccgccgacgaguccaccaacaccgccuacauggagcucuccucccuccgcuccgaggacaccgccgucuacuacugcgcccgcggcggcggcgucuucgacuacuggggccagggcacccucgucaccgucuccucc

SEQ ID NO: 15472 - RNA, 1326 nt, Artificial Sequence
  derived and/or modified sequence opt2 from Daclizumab_HeavyChain
cagguccagcucguccaguccggcgccgaggucaagaagcccggcuccuccgucaaggucuccugcaaggccuccggcuacaccuucaccuccuaccgcaugcacuggguccgccaggcccccggccagggccucgaguggaucggcuacaucaaccccuccaccggcuacaccgaguacaaccagaaguucaaggacaaggccaccaucaccgccgacgaguccaccaacaccgccuacauggagcucuccucccuccgcuccgaggacaccgccgucuacuacugcgcccgcggcggcggcgucuucgacuacuggggccagggcaccacccucaccgucuccuccggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15473 - RNA, 630 nt, Artificial Sequence
  derived and/or modified sequence opt2 from Daclizumab_LightChain
gacauccagaugacccagucccccuccacccucuccgccuccgucggcgaccgcgucaccaucaccugcuccgccuccuccuccaucuccuacaugcacugguaccagcagaagcccggcaaggcccccaagcuccucaucuacaccaccuccaaccucgccuccggcguccccgcccgcuucuccggcuccggcuccggcaccgaguucacccucaccaucuccucccuccagcccgacgacuucgccaccuacuacugccaccagcgcuccaccuacccccucaccuucggcuccggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 15474 - RNA, 1341 nt, Artificial Sequence
  derived and/or modified sequence opt2 from Dalotuzumab_HeavyChain1
cagguccagcuccagcaguccggccccggccucgucaagcccucccagacccucucccucaccugcaccgucuccggcugguccaucuccggcggcuggcucuggaacuggauccgccagccccccggcaagggccuccaguggaucggcuggaucuccugggacggcaccaacaacuggaagcccucccucaaggaccgcgucaccaucuccgucgacaccuccaagaaccaguucucccucaagcucuccuccgucaccgccgccgacaccgccgucugguggugcgcccgcuggggccgcgucuucuucgacugguggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15475 - RNA, 657 nt, Artificial Sequence
  derived and/or modified sequence opt2 from Dalotuzumab_LightChain1
gacaucgucaugacccaguccccccucucccuccccgucacccccggccagcccgccuccaucuccugccgcuccucccaguccaucguccacuccaacggcaacaccuggcuccagugguggcuccagaagcccggccaguccccccagcuccucaucuggaaggucuccaaccgccucuggggcguccccgaccgcuucuccggcuccggcuccggcaccgacuucacccucaagaucucccgcguccaggcccaggacgucggcgucugguggugcuuccagggcucccacguccccuggaccuucggccagggcaccaagguccagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15476 - RNA, 687 nt, Artificial Sequence
  derived and/or modified sequence opt2 from Dapirolizumab_pegol_HeavyChain1
gagguccagcucgucgaguccggcggcggccucguccagcccggcggcucccuccgccucuccugcgccgucuccggcuucuccuccaccaacuaccacguccacuggguccgccaggcccccggcaagggccucgaguggaugggcgucaucuggggcgacggcgacaccuccuacaacuccguccucaagucccgcuucaccaucucccgcgacaccuccaagaacaccgucuaccuccagaugaacucccuccgcgccgaggacaccgccgucuacuacugcgcccgccagcucacccacuacuacguccucgccgccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcgccgcc

SEQ ID NO: 15477 - RNA, 642 nt, Artificial Sequence
  derived and/or modified sequence opt2 from Dapirolizumab_pegol_LightChain1
gacauccagaugacccagucccccuccucccucuccgccuccgucggcgaccgcgucaccaucaccugccgcgccuccgaggaccucuacuacaaccucgccugguaccagcgcaagcccggcaaggcccccaagcuccucaucuacgacaccuaccgccucgccgacggcguccccucccgcuucuccggcuccggcuccggcaccgacuacacccucaccaucuccucccuccagcccgaggacuucgccuccuacuacugccagcaguacuacaaguuccccuucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15478 - RNA, 1356 nt, Artificial Sequence
  derived and/or modified sequence opt2 from Daratumumab_HeavyChain1
gagguccagcuccucgaguccggcggcggccucguccagcccggcggcucccuccgccucuccugcgccgucuccggcuucaccuucaacuccuucgccauguccuggguccgccaggcccccggcaagggccucgagugggucuccgccaucuccggcuccggcggcggcaccuacuacgccgacuccgucaagggccgcuucaccaucucccgcgacaacuccaagaacacccucuaccuccagaugaacucccuccgcgccgaggacaccgccgucuacuucugcgccaaggacaagauccucugguucggcgagcccgucuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15479 - RNA, 642 nt, Artificial Sequence
  derived and/or modified sequence opt2 from Daratumumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15480 - RNA, 1350 nt, Artificial Sequence
  derived and/or modified sequence opt2 from Dectrekumab_HeavyChain1
gagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccaucaucugguacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgccucugguucggcgaccucgacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15481 - RNA, 648 nt, Artificial Sequence
  derived and/or modified sequence opt2 from Dectrekumab_LightChain1
gagaucguccucacccagucccccgccacccucucccucucccccggcgagcgcgccauccucuccugccgcgccggccaguccgucuccuccuaccucgucugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccuccuggccccccgucuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15482 - RNA, 1332 nt, Artificial Sequence
  derived and/or modified sequence opt2 from Demcizumab_HeavyChain1
cagguccagcucguccaguccggcgccgaggucaagaagcccggcgccuccgucaagaucuccugcaaggccuccggcuacuccuucaccgccuacuacauccacugggucaagcaggcccccggccagggccucgaguggaucggcuacaucuccuccuacaacggcgccaccaacuacaaccagaaguucaagggccgcgucaccuucaccaccgacaccuccaccuccaccgccuacauggagcuccgcucccuccgcuccgacgacaccgccgucuacuacugcgcccgcgacuacgacuacgacgucggcauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15483 - RNA, 654 nt, Artificial Sequence
  derived and/or modified sequence opt2 from Demcizumab_LightChain1
gacaucgucaugacccagucccccgacucccucgccgucucccucggcgagcgcgccaccaucuccugccgcgccuccgaguccgucgacaacuacggcaucuccuucaugaagugguuccagcagaagcccggccagccccccaagcuccucaucuacgccgccuccaaccagggcuccggcguccccgaccgcuucuccggcuccggcuccggcaccgacuucacccucaccaucuccucccuccaggccgaggacgucgccgucuacuacugccagcaguccaaggagguccccuggaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15484 - RNA, 1350 nt, Artificial Sequence
  derived and/or modified sequence opt2 from Denintuzumab_mafodotin_HeavyChain1
cagguccagcuccaggaguccggccccggccucgucaagcccucccagacccucucccucaccugcaccgucuccggcggcuccaucuccaccuccggcaugggcgucggcuggauccgccagcaccccggcaagggccucgaguggaucggccacaucuggugggacgacgacaagcgcuacaaccccgcccucaagucccgcgucaccaucuccgucgacaccuccaagaaccaguucucccucaagcucuccuccgucaccgccgccgacaccgccgucuacuacugcgcccgcauggagcucugguccuacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15485 - RNA, 639 nt, Artificial Sequence
  derived and/or modified sequence opt2 from Denintuzumab_mafodotin_LightChain1
gagaucguccucacccagucccccgccacccucucccucucccccggcgagcgcgccacccucuccugcuccgccuccuccuccgucuccuacaugcacugguaccagcagaagcccggccaggccccccgccuccucaucuacgacaccuccaagcucgccuccggcauccccgcccgcuucuccggcuccggcuccggcaccgacuucacccucaccaucuccucccucgagcccgaggacgucgccgucuacuacugcuuccagggcuccgucuaccccuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15486 - RNA, 1356 nt, Artificial Sequence
  derived and/or modified sequence opt2 from Denosumab_HeavyChain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccggcaucaccggcuccggcggcuccaccuacuacgccgacuccgucaagggccgcuucaccaucucccgcgacaacuccaagaacacccucuaccuccagaugaacucccuccgcgccgaggacaccgccgucuacuacugcgccaaggaccccggcaccaccgucaucauguccugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15487 - RNA, 645 nt, Artificial Sequence
  derived and/or modified sequence opt2 from Denosumab_LightChain
gagaucguccucacccagucccccggcacccucucccucucccccggcgagcgcgccacccucuccugccgcgccucccaguccguccgcggccgcuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuucuacugccagcaguacggcuccuccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15488 - RNA, 1338 nt, Artificial Sequence
  derived and/or modified sequence opt2 from Depatuxizumab_HeavyChain1
cagguccagcuccaggaguccggccccggccucgucaagcccucccagacccucucccucaccugcaccgucuccggcuacuccaucuccuccgacuucgccuggaacuggauccgccagccccccggcaagggccucgaguggaugggcuacaucuccuacuccggcaacacccgcuaccagcccucccucaagucccgcaucaccaucucccgcgacaccuccaagaaccaguucuuccucaagcucaacuccgucaccgccgccgacaccgccaccuacuacugcgucaccgccggccgcggcuuccccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15489 - RNA, 642 nt, Artificial Sequence
  derived and/or modified sequence opt2 from Depatuxizumab_LightChain1
gacauccagaugacccagucccccuccuccauguccgucuccgucggcgaccgcgucaccaucaccugccacuccucccaggacaucaacuccaacaucggcuggcuccagcagaagcccggcaaguccuucaagggccucaucuaccacggcaccaaccucgacgacggcguccccucccgcuucuccggcuccggcuccggcaccgacuacacccucaccaucuccucccuccagcccgaggacuucgccaccuacuacugcguccaguacgcccaguuccccuggaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15490 - RNA, 1338 nt, Artificial Sequence; identical to SEQ ID NO: 15488
  derived and/or modified sequence opt2 from Depatuxizumab_mafodotin_HeavyChain1

SEQ ID NO: 15491 - RNA, 642 nt, Artificial Sequence; identical to SEQ ID NO: 15489
  derived and/or modified sequence opt2 from Depatuxizumab_mafodotin_LightChain1

SEQ ID NO: 15492 - RNA, 1329 nt, Artificial Sequence
  derived and/or modified sequence opt2 from Dinutuximab_beta_HeavyChain1
gagguccagcuccuccaguccggccccgagcucgagaagcccggcgccuccgucaugaucuccugcaaggccuccggcuccuccuucaccggcuacaacaugaacuggguccgccagaacaucggcaagucccucgaguggaucggcgccaucgaccccuacuacggcggcaccuccuacaaccagaaguucaagggccgcgccacccucaccgucgacaaguccuccuccaccgccuacaugcaccucaagucccucaccuccgaggacuccgccgucuacuacugcgucuccggcauggaguacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15493 - RNA, 660 nt, Artificial Sequence
  derived and/or modified sequence opt2 from Dinutuximab_beta_LightChain1
gagaucgucaugacccagucccccgccacccucuccgucucccccggcgagcgcgccacccucuccugccgcuccucccagucccucguccaccgcaacggcaacaccuaccuccacugguaccuccagaagcccggccagucccccaagcuccucauccacaaggucuccaaccgcuucuccggcguccccgaccgcuucuccggcuccggcuccggcaccgacuucacccucaagaucucccgcgucgaggccgaggaccucggcgucuacuucugcucccaguccacccacguccccccccucaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15494 - RNA, 1329 nt, Artificial Sequence; identical to SEQ ID NO: 15492
  derived and/or modified sequence opt2 from Dinutuximab_HeavyChain1

SEQ ID NO: 15495 - RNA, 660 nt, Artificial Sequence; identical to SEQ ID NO: 15493
  derived and/or modified sequence opt2 from Dinutuximab_LightChain1

SEQ ID NO: 15496 - RNA, 660 nt, Artificial Sequence; identical to SEQ ID NO: 15493
  derived and/or modified sequence opt2 from Dinutuximab_LightChain

SEQ ID NO: 15497 - RNA, 1350 nt, Artificial Sequence
  derived and/or modified sequence opt2 from Diridavumab_HeavyChain1
gagguccagcucgucgaguccggcgccgaggucaagaagcccggcuccuccgucaaggucuccugcaaggccuccggcggccccuuccgcuccuacgccaucuccuggguccgccaggcccccggccagggccccgaguggaugggcggcaucauccccaucuucggcaccaccaaguacgcccccaaguuccagggccgcgucaccaucaccgccgacgacuucgccggcaccgucuacauggagcucuccucccuccgcuccgaggacaccgccauguacuacugcgccaagcacaugggcuaccagguccgcgagaccauggacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15498 - RNA, 651 nt, Artificial Sequence
  derived and/or modified sequence opt2 from Diridavumab_LightChain1
caguccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcgccaccugggaccgccgccccaccgccuacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15499 - RNA, 1338 nt, Artificial Sequence
  derived and/or modified sequence opt2 from Domagrozumab_HeavyChain1
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccaccaucuccuccggcggcuccuacaccuccuaccccgacuccgucaagggccgcuucaccaucucccgcgacaacuccaagaacacccucuaccuccagaugaacucccuccgcgccgaggacaccgccgucuacuacugcgccaagcaggacuacgccaugaacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15500 - RNA, 1335 nt, Artificial Sequence
  derived and/or modified sequence opt2 from Domagrozumab_HeavyChain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccaccaucuccuccggcggcuccuacaccuccuaccccgacuccgucaagggccgcuucaccaucucccgcgacaacuccaagaacacccucuaccuccagaugaacucccuccgcgccgaggacaccgccgucuacuacugcgccaagcaggacuacgccaugaacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15501 - RNA, 642 nt, Artificial Sequence
  derived and/or modified sequence opt2 from Domagrozumab_LightChain1
gacauccagaugacccagucccccuccucccucuccgccuccgucggcgaccgcgucaccaucaccugcaaggccucccaggacgucuccaccgccgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcagcacuacuccacccccuggaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15502 - RNA, 1335 nt, Artificial Sequence
  derived and/or modified sequence opt2 from Drozituab_HeavyChain1
gagguccagcucguccaguccggcggcggcgucgagcgccccggcggcucccuccgccucuccugcgccgccuccggcuucaccuucgacgacuacgccuccuggguccgccaggcccccggcaagggccucgagugggucuccggcaucaacuggcagggcggcuccaccggcuacgccgacuccgucaagggccgcgucaccaucucccgcgacaacgccaagaacucccucuaccuccagaacucccuccgcgccgaggacaccgccgucuacuacugcgccaagauccucggcgccggccgcggcugguacuucgacuacuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15503 - RNA, 639 nt, Artificial Sequence
  derived and/or modified sequence opt2 from Drozituab_LightChain1
uccgagcucacccaggaccccgccgucuccgucgcccucggccagaccguccgcaucaccugcuccggcgacucccuccgcuccuacuacgccuccugguaccagcagaagcccggccaggcccccguccucgucaucuacggcgccaacaaccgccccuccggcauccccgaccgcuucuccggcuccuccuccggcaacaccgccucccucaccaucaccggcgcccaggccgaggacgaggccgacuacuacugcaacuccgccgacuccuccggcaaccacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 15504 - RNA, 1353 nt, Artificial Sequence
  derived and/or modified sequence opt2 from Drozitumab_HeavyChain1
gagguccagcucguccaguccggcggcggcgucgagcgccccggcggcucccuccgccucuccugcgccgccuccggcuucaccuucgacgacuacgccauguccuggguccgccaggcccccggcaagggccucgagugggucuccggcaucaacuggcagggcggcuccaccggcuacgccgacuccgucaagggccgcgucaccaucucccgcgacaacgccaagaacucccucuaccuccagaugaacucccuccgcgccgaggacaccgccgucuacuacugcgccaagauccucggcgccggccgcggcugguacuucgacuacuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15505 - RNA, 639 nt, Artificial Sequence; identical to SEQ ID NO: 15503
  derived and/or modified sequence opt2 from Drozitumab_LightChain1

SEQ ID NO: 15506 - RNA, 1353 nt, Artificial Sequence
  derived and/or modified sequence opt2 from Duligotumab_HeavyChain1
gagguccagcucgucgaguccggcggcggccucguccagcccggcggcucccuccgccucuccugcgccgccuccggcuucacccucuccggcgacuggauccacuggguccgccaggcccccggcaagggccucgagugggucggcgagaucuccgccgccggcggcuacaccgacuacgccgacuccgucaagggccgcuucaccaucuccgccgacaccuccaagaacaccgccuaccuccagaugaacucccuccgcgccgaggacaccgccgucuacuacugcgcccgcgagucccgcgucuccuucgaggccgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15507 - RNA, 642 nt, Artificial Sequence
  derived and/or modified sequence opt2 from Duligotumab_LightChain1
gacauccagaugacccagucccccuccucccucuccgccuccgucggcgaccgcgucaccaucaccugccgcgccucccagaacaucgccaccgacgucgccugguaccagcagaagcccggcaaggcccccaagcuccucaucuacuccgccuccuuccucuacuccggcguccccucccgcuucuccggcuccggcuccggcaccgacuucacccucaccaucuccucccuccagcccgaggacuucgccaccuacuacugccagcaguccgagcccgagcccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15508 - RNA, 1353 nt, Artificial Sequence; identical to SEQ ID NO: 15506
  derived and/or modified sequence opt2 from Duligotuzumab_HeavyChain1

SEQ ID NO: 15509 - RNA, 642 nt, Artificial Sequence; identical to SEQ ID NO: 15507
  derived and/or modified sequence opt2 from Duligotuzumab_LightChain1

SEQ ID NO: 15510 - RNA, 1353 nt, Artificial Sequence
  derived and/or modified sequence opt2 from Dupilumab_HeavyChain1
gagguccagcucgucgaguccggcggcggccucgagcagcccggcggcucccuccgccucuccugcgccggcuccggcuucaccuuccgcgacuacgccaugaccuggguccgccaggcccccggcaagggccucgagugggucuccuccaucuccggcuccggcggcaacaccuacuacgccgacuccgucaagggccgcuucaccaucucccgcgacaacuccaagaacacccucuaccuccagaugaacucccuccgcgccgaggacaccgccgucuacuacugcgccaaggaccgccucuccaucaccauccgcccccgcuacuacggccucgacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15511 - RNA, 657 nt, Artificial Sequence
  derived and/or modified sequence opt2 from Dupilumab_LightChain1
gacaucgucaugacccaguccccccucucccuccccgucacccccggcgagcccgccuccaucuccugccgcuccucccagucccuccucuacuccaucggcuacaacuaccucgacugguaccuccagaaguccggccaguccccccagcuccucaucuaccucggcuccaaccgcgccuccggcguccccgaccgcuucuccggcuccggcuccggcaccgacuucacccucaagaucucccgcgucgaggccgaggacgucggcuucuacuacugcaugcaggcccuccagacccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15512 - RNA, 1353 nt, Artificial Sequence
  derived and/or modified sequence opt2 from Durvalumab_HeavyChain1
gagguccagcucgucgaguccggcggcggccucguccagcccggcggcucccuccgccucuccugcgccgccuccggcuucaccuucucccgcuacuggauguccuggguccgccaggcccccggcaagggccucgagugggucgccaacaucaagcaggacggcuccgagaaguacuacgucgacuccgucaagggccgcuucaccaucucccgcgacaacgccaagaacucccucuaccuccagaugaacucccuccgcgccgaggacaccgccgucuacuacugcgcccgcgagggcggcugguucggcgagcucgccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaguucgagggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgccuccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15513 - RNA, 645 nt, Artificial Sequence
  derived and/or modified sequence opt2 from Durvalumab_LightChain1
gagaucguccucacccagucccccggcacccucucccucucccccggcgagcgcgccacccucuccugccgcgccucccagcgcgucuccuccuccuaccucgccugguaccagcagaagcccggccaggccccccgccuccucaucuacgacgccuccucccgcgccaccggcauccccgaccgcuucuccggcuccggcuccggcaccgacuucacccucaccaucucccgccucgagcccgaggacuucgccgucuacuacugccagcaguacggcucccuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15514 - RNA, 1338 nt, Artificial Sequence
  derived and/or modified sequence opt2 from Dusigitumab_HeavyChain1
cagguccagcucguccaguccggcgccgaggucaagaagcccggcgccuccgucaaggucuccugcaaggccuccggcuacaccuucaccuccuacgacaucaacuggguccgccaggccaccggccagggccucgaguggaugggcuggaugaaccccaacuccggcaacaccggcuacgcccagaaguuccagggccgcgucaccaugacccgcaacaccuccaucuccaccgccuacauggagcucuccucccuccgcuccgaggacaccgccgucuacuacugcgcccgcgaccccuacuacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15515 - RNA, 651 nt, Artificial Sequence
  derived and/or modified sequence opt2 from Dusigitumab_LightChain1
caguccguccucacccagccccccuccgucuccgccgcccccggccagaaggucaccaucuccugcuccggcuccuccuccaacaucgagaacaaccacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcgagaccugggacaccucccucuccgccggccgcgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15516 - RNA, 1347 nt, Artificial Sequence
  derived and/or modified sequence opt2 from Ecromeximab_HeavyChain1
gaggucacccucgucgaguccggcggcgacuucgucaagcccggcggcucccucaaggucuccugcgccgccuccggcuucgccuucucccacuacgccauguccuggguccgccagacccccgccaagcgccucgagugggucgccuacaucuccuccggcggcuccggcaccuacuacuccgacuccgucaagggccgcuucaccaucucccgcgacaacgccaagaacacccucuaccuccagaugcgcucccuccgcuccgaggacuccgccauguacuucugcacccgcgucaagcucggcaccuacuacuucgacuccuggggccagggcaccacccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15517 - RNA, 642 nt, Artificial Sequence
  derived and/or modified sequence opt2 from Ecromeximab_LightChain1
gacauccagaugacccagaccgccuccucccuccccgccucccucggcgaccgcgucaccaucuccugcuccgccucccaggacaucuccaacuaccucaacugguaccagcagaagcccgacggcaccgucaagcuccucaucuucuacuccuccaaccuccacuccggcguccccucccgcuucuccggcggcggcuccggcaccgacuacucccucaccaucuccaaccucgagcccgaggacaucgccaccuacuucugccaccaguacuccaagcuccccuggaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15518 - RNA, 1341 nt, Artificial Sequence
  derived and/or modified sequence opt2 from Eculizumab_HeavyChain1
guccagcucguccaguccggcgccgaggucaagaagcccggcgccuccgucaaggucuccugcaaggccuccggcuacaucuucuccaacuacuggauccaguggguccgccaggcccccggccagggccucgaguggaugggcgagauccuccccggcuccggcuccaccgaguacaccgagaacuucaaggaccgcgucaccaugacccgcgacaccuccaccuccaccgucuacauggagcucuccucccuccgcuccgaggacaccgccgucuacuacugcgcccgcuacuucuucggcuccucccccaacugguacuucgacgucuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15519 - RNA, 642 nt, Artificial Sequence
  derived and/or modified sequence opt2 from Eculizumab_LightChain1
gacauccagaugacccagucccccuccucccucuccgccuccgucggcgaccgcgucaccaucaccugcggcgccuccgagaacaucuacggcgcccucaacugguaccagcagaagcccggcaaggcccccaagcuccucaucuacggcgccaccaaccucgccgacggcguccccucccgcuucuccggcuccggcuccggcaccgacuucacccucaccaucuccucccuccagcccgaggacuucgccaccuacuacugccagaacguccucaacaccccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15520 - RNA, 375 nt, Artificial Sequence
  derived and/or modified sequence opt2 from Efalizumab_HeavyChain
gagguccagcucgucgaguccggcggcggccucguccagcccggcggcucccuccgccucuccugcgccgccuccggcuacuccuucaccggccacuggaugaacuggguccgccaggcccccggcaagggccucgagugggucggcaucaugauccaccccuccgacuccgagacccgcuacaaccagaaguucaaggacauccgcuucaccaucuccgucgacaaguccaagaacacccucuaccuccagaugaacucccuccgcgccgaggacaccgccgucuacuacugcgcccgcaucggcaucuacuucuacggcaccaccuacuucgacuacaucuggggccagggcacccucgucaccgucuccucc

SEQ ID NO: 15521 - RNA, 324 nt, Artificial Sequence
  derived and/or modified sequence opt2 from Efalizumab_LightChain
gacauccagaugacccagucccccuccucccucuccgccuccgucggcgaccgcgucaccaucaccugccgcgccuccaagaccaucuccaaguaccucgccugguaccagcagaagcccggcaaggcccccaagcuccucaucuacuccggcuccacccuccaguccggcguccccucccgcuucuccggcuccggcuccggcaccgacuucacccucaccaucuccucccuccagcccgaggacuucgccaccuacuacugccagcagcacaacgaguacccccucaccuucggccagggcaccaaggucgagaucaagcgc

SEQ ID NO: 15522 - RNA, 768 nt, Artificial Sequence
  derived and/or modified sequence opt2 from Efungumab_SingleChain_variable_fragment
auggccgagguccagcucgucgaguccggcgccgaggucaagaagcccggcgagucccuccgcaucuccugcaagggcuccggcugcaucaucuccuccuacuggaucuccuggguccgccagaugcccggcaagggccucgaguggaugggcaagaucgaccccggcgacuccuacaucaacuacucccccuccuuccagggccacgucaccaucuccgccgacaaguccaucaacaccgccuaccuccaguggaacucccucaaggccuccgacaccgccauguacuacugcgcccgcggcggccgcgacuucggcgacuccuucgacuacuggggccagggcacccucgucaccgucuccuccggcggcggcggcuccggcggcggcggcuccggcggcggcggcuccgacgucgucaugacccagucccccuccuuccucuccgccuucgucggcgaccgcaucaccaucaccugccgcgccuccuccggcaucucccgcuaccucgccugguaccagcaggcccccggcaaggcccccaagcuccucaucuacgccgccuccacccuccagaccggcguccccucccgcuucuccggcuccggcuccggcaccgaguucacccucaccaucaacucccuccagcccgaggacuucgccaccuacuacugccagcaccucaacuccuacccccucaccuucggcggcggcaccaaggucgacaucaagcgcgccgccgcccucgagcaccaccaccaccaccac

SEQ ID NO: 15523 - RNA, 1362 nt, Artificial Sequence
  derived and/or modified sequence opt2 from Eldelumab_HeavyChain1
cagaugcagcucgucgaguccggcggcggcgucguccagcccggccgcucccuccgccucuccugcaccgccuccggcuucaccuucuccaacaacggcaugcacuggguccgccaggcccccggcaagggccucgagugggucgccgucaucugguucgacggcaugaacaaguucuacgucgacuccgucaagggccgcuucaccaucucccgcgacaacuccaagaacacccucuaccucgagaugaacucccuccgcgccgaggacaccgccaucuacuacugcgcccgcgagggcgacggcuccggcaucuacuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15524 - RNA, 648 nt, Artificial Sequence
  derived and/or modified sequence opt2 from Eldelumab_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccccaucuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15525 - RNA, 1341 nt, Artificial Sequence
  derived and/or modified sequence opt2 from Elgemtumab_HeavyChain1
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccgccaucaacucccagggcaaguccaccuacuacgccgacuccgucaagggccgcuucaccaucucccgcgacaacuccaagaacacccucuaccuccagaugaacucccuccgcgccgaggacaccgccgucuacuacugcgcccgcuggggcgacgagggcuucgacaucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15526 - RNA, 642 nt, Artificial Sequence
  derived and/or modified sequence opt2 from Elgemtumab_LightChain1
gacauccagaugacccagucccccuccucccucuccgccuccgucggcgaccgcgucaccaucaccugccgcgccucccagggcaucuccaacuggcucgccugguaccagcagaagcccggcaaggcccccaagcuccucaucuacggcgccuccucccuccaguccggcguccccucccgcuucuccggcuccggcuccggcaccgacuucacccucaccaucuccucccuccagcccgaggacuucgccaccuacuacugccagcaguacuccuccuuccccaccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15527 - RNA, 1347 nt, Artificial Sequence
  derived and/or modified sequence opt2 from Elotuzumab_HeavyChain1
gagguccagcucgucgaguccggcggcggccucguccagcccggcggcucccuccgccucuccugcgccgccuccggcuucgacuucucccgcuacuggauguccuggguccgccaggcccccggcaagggccucgaguggaucggcgagaucaaccccgacuccuccaccaucaacuacgcccccucccucaaggacaaguucaucaucucccgcgacaacgccaagaacucccucuaccuccagaugaacucccuccgcgccgaggacaccgccgucuacuacugcgcccgccccgacggcaacuacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15528 - RNA, 642 nt, Artificial Sequence
  derived and/or modified sequence opt2 from Elotuzumab_LightChain1
gacauccagaugacccagucccccuccucccucuccgccuccgucggcgaccgcgucaccaucaccugcaaggccucccaggacgucggcaucgccgucgccugguaccagcagaagcccggcaagguccccaagcuccucaucuacugggccuccacccgccacaccggcguccccgaccgcuucuccggcuccggcuccggcaccgacuucacccucaccaucuccucccuccagcccgaggacgucgccaccuacuacugccagcaguacuccuccuaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15529 - RNA, 1338 nt, Artificial Sequence
  derived and/or modified sequence opt2 from Emactuzumab_HeavyChain1
cagguccagcucguccaguccggcgccgaggucaagaagcccggcgccuccgucaaggucuccugcaaggccuccggcuacaccuucaccuccuacgacaucuccuggguccgccaggcccccggccagggccucgaguggaugggcgucaucuggaccgacggcggcaccaacuacgcccagaagcuccagggccgcgucaccaugaccaccgacaccuccaccuccaccgccuacauggagcuccgcucccuccgcuccgacgacaccgccgucuacuacugcgcccgcgaccagcgccucuacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15530 - RNA, 639 nt, Artificial Sequence
  derived and/or modified sequence opt2 from Emactuzumab_LightChain1
gacauccagaugacccagucccccuccucccucuccgccuccgucggcgaccgcgucaccaucaccugccgcgccuccgaggacgucaacaccuacgucuccugguaccagcagaagcccggcaaggcccccaagcuccucaucuacgccgccuccaaccgcuacaccggcguccccucccgcuucuccggcuccggcuccggcaccgacuucacccucaccaucuccucccuccagcccgaggacuucgccaccuacuacugccagcaguccuucuccuaccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15531 - RNA, 1323 nt, Artificial Sequence
  derived and/or modified sequence opt2 from Emibetuzumab_HeavyChain1
cagguccagcucguccaguccggcgccgaggucaagaagcccggcgccuccgucaaggucuccugcaaggccuccggcuacaccuucaccgacuacuacaugcacuggguccgccaggcccccggccagggccucgaguggaugggccgcgucaaccccaaccgccgcggcaccaccuacaaccagaaguucgagggccgcgucaccaugaccaccgacaccuccaccuccaccgccuacauggagcuccgcucccuccgcuccgacgacaccgccgucuacuacugcgcccgcgccaacuggcucgacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaggccgccggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15532 - RNA, 645 nt, Artificial Sequence
  derived and/or modified sequence opt2 from Emibetuzumab_LightChain1
gacauccagaugacccagucccccuccucccucuccgccuccgucggcgaccgcgucaccaucaccugcuccgucuccuccuccgucuccuccaucuaccuccacugguaccagcagaagcccggcaaggcccccaagcuccucaucuacuccaccuccaaccucgccuccggcguccccucccgcuucuccggcuccggcuccggcaccgacuucacccucaccaucuccucccuccagcccgaggacuucgccaccuacuacugccaggucuacuccggcuacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15533 - RNA, 1344 nt, Artificial Sequence
  derived and/or modified sequence opt2 from Emicizumab_HeavyChain1
cagguccagcucgucgaguccggcggcggccucguccagcccggcggcucccuccgccucuccugcgccgccuccggcuucaccuucuccuacuacgacauccaguggguccgccaggcccccggcaagggccucgagugggucuccuccaucucccccuccggccaguccaccuacuaccgccgcgaggucaagggccgcuucaccaucucccgcgacaacuccaagaacacccucuaccuccagaugaacucccuccgcgccgaggacaccgccgucuacuacugcgcccgccgcaccggccgcgaguacggcggcggcugguacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccagaaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcaggagggcaacgucuucuccugcuccgucaugcacgaggcccuccacaaccgcuacacccagaagucccucucccucuccccc

SEQ ID NO: 15534 - RNA, 1332 nt, Artificial Sequence
  derived and/or modified sequence opt2 from Emicizumab_HeavyChain2
cagguccagcucguccaguccggcuccgagcucaagaagcccggcgccuccgucaaggucuccugcaaggccuccggcuacaccuucaccgacaacaacauggacuggguccgccaggcccccggccagggccucgaguggaugggcgacaucaacacccgcuccggcggcuccaucuacaacgaggaguuccaggaccgcgucaucaugaccgucgacaaguccaccgacaccgccuacauggagcucuccucccuccgcuccgaggacaccgccaccuaccacugcgcccgccgcaaguccuacggcuacuaccucgacgaguggggcgagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcaggagggcaacgucuucuccugcuccgucaugcacgaggcccuccacaaccacuacacccaggagucccucucccucuccccc

SEQ ID NO: 15535 - RNA, 642 nt, Artificial Sequence
  derived and/or modified sequence opt2 from Emicizumab_LightChain1
gacauccagaugacccagucccccuccucccucuccgccuccgucggcgaccgcgucaccaucaccugcaaggccucccgcaacaucgagcgccagcucgccugguaccagcagaagcccggccaggcccccgagcuccucaucuaccaggccucccgcaaggaguccggcguccccgaccgcuucuccggcucccgcuacggcaccgacuucacccucaccaucuccucccuccagcccgaggacaucgccaccuacuacugccagcaguacuccgaccccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15536 - RNA, 1347 nt, Artificial Sequence
  derived and/or modified sequence opt2 from Enavatuzumab_HeavyChain1
gagguccagcucgucgaguccggcggcggccucguccagcccggcggcucccuccgccucuccugcgccgccuccggcuucaccuucuccuccuacuggauguccuggguccgccaggcccccggcaagggccucgagugggucgccgagauccgccucaaguccgacaacuacgccacccacuacgccgaguccgucaagggccgcuucaccaucucccgcgacgacuccaagaacucccucuaccuccagaugaacucccuccgcgccgaggacaccgccgucuacuacugcaccggcuacuacgccgacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15537 - RNA, 654 nt, Artificial Sequence
  derived and/or modified sequence opt2 from Enavatuzumab_LightChain1
gacauccagaugacccagucccccuccucccucuccgccuccgucggcgaccgcgucaccaucaccugccgcgccucccaguccgucuccaccuccuccuacuccuacaugcacugguaccagcagaagcccggcaaggcccccaagcuccucaucaaguacgccuccaaccucgaguccggcguccccucccgcuucuccggcuccggcuccggcaccgacuucacccucaccaucuccucccuccagcccgaggacuucgccaccuacuacugccagcacuccugggagauccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15538 - RNA, 1341 nt, Artificial Sequence
  derived and/or modified sequence opt2 from Enfortumab_HeavyChain
gagguccagcucgucgaguccggcggcggccucguccagcccggcggcucccuccgccucuccugcgccgccuccggcuucaccuucuccuccuacaacaugaacuggguccgccaggcccccggcaagggccucgagugggucuccuacaucuccuccuccuccuccaccaucuacuacgccgacuccgucaagggccgcuucaccaucucccgcgacaacgccaagaacucccucucccuccagaugaacucccuccgcgacgaggacaccgccgucuacuacugcgcccgcgccuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15539 - RNA, 642 nt, Artificial Sequence
  derived and/or modified sequence opt2 from Enfortumab_LightChain
gacauccagaugacccagucccccuccuccgucuccgccuccgucggcgaccgcgucaccaucaccugccgcgccucccagggcaucuccggcuggcucgccugguaccagcagaagcccggcaaggcccccaaguuccucaucuacgccgccuccacccuccaguccggcguccccucccgcuucuccggcuccggcuccggcaccgacuucacccucaccaucuccucccuccagcccgaggacuucgccaccuacuacugccagcaggccaacuccuucccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15540 - RNA, 1341 nt, Artificial Sequence; identical to SEQ ID NO: 15538
  derived and/or modified sequence opt2 from Enfortumab_vedotin_HeavyChain1

SEQ ID NO: 15541 - RNA, 642 nt, Artificial Sequence; identical to SEQ ID NO: 15539
  derived and/or modified sequence opt2 from Enfortumab_vedotin_LightChain1

SEQ ID NO: 15542 - RNA, 1356 nt, Artificial Sequence
  derived and/or modified sequence opt2 from Enoblituzumab_HeavyChain
gagguccagcucgucgaguccggcggcggccucguccagcccggcggcucccuccgccucuccugcgccgccuccggcuucaccuucuccuccuucggcaugcacuggguccgccaggcccccggcaagggccucgagugggucgccuacaucuccuccgacuccuccgccaucuacuacgccgacaccgucaagggccgcuucaccaucucccgcgacaacgccaagaacucccucuaccuccagaugaacucccuccgcgacgaggacaccgccgucuacuacugcggccgcggccgcgagaacaucuacuacggcucccgccucgacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcucgucggcggccccuccgucuuccuccucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccccgaggagcaguacaacuccacccuccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccucguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15543 - RNA, 642 nt, Artificial Sequence
  derived and/or modified sequence opt2 from Enoblituzumab_LightChain
gacauccagcucacccagucccccuccuuccucuccgccuccgucggcgaccgcgucaccaucaccugcaaggccucccagaacgucgacaccaacgucgccugguaccagcagaagcccggcaaggcccccaaggcccucaucuacuccgccuccuaccgcuacuccggcguccccucccgcuucuccggcuccggcuccggcaccgacuucacccucaccaucuccucccuccagcccgaggacuucgccaccuacuacugccagcaguacaacaacuaccccuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15544 - RNA, 1356 nt, Artificial Sequence
  derived and/or modified sequence opt2 from Enokizumab_HeavyChain1
cagguccagcucguccaguccggcgccgaggucaagaagcccggcuccuccgucaaggucuccugcaaggccuccggcggcaccuucuccuacuacuggaucgaguggguccgccaggcccccggccagggccucgaguggaugggcgagauccuccccggcuccggcaccaccaaccccaacgagaaguucaagggccgcgucaccaucaccgccgacgaguccaccuccaccgccuacauggagcucuccucccuccgcuccgaggacaccgccgucuacuacugcgcccgcgccgacuacuacggcuccgacuacgucaaguucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15545 - RNA, 642 nt, Artificial Sequence
  derived and/or modified sequence opt2 from Enokizumab_LightChain1
gacauccagaugacccagucccccuccucccucuccgccuccgucggcgaccgcgucaccaucaccugcaaggccucccagcacgucaucacccacgucaccugguaccagcagaagcccggcaaggcccccaagcuccucaucuacggcaccuccuacuccuacuccggcguccccucccgcuucuccggcuccggcuccggcaccgacuucacccucaccaucuccucccuccagcccgaggacuucgccaccuacuacugccagcaguucuacgaguacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15546 - RNA, 612 nt, Artificial Sequence
  derived and/or modified sequence opt2 from Enokizumab_LightChain
gacauccagaugacccagucccccuccucccucuccgccuccgucggcgaccgcgucaccaucaccugcaaggccucccagcacgucaucacccacgucaccugguaccagcagaagcccggcaaggcccccaagcuccucaucuacggcaccuccuacuccuacuccggcguccccucccgcuucuccggcuccggcuccggcaccgacuucacccucaccaucuccucccuccagcccgaggacuucgccaccuacuacugccagcaguucuacgaguacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15547 - RNA, 1356 nt, Artificial Sequence
  derived and/or modified sequence opt2 from Enoticumab_HeavyChain1
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucuccuuccucugguacgacggcaccaacaagaacuacgucgaguccgucaagggccgcuucaccaucucccgcgacaacuccaagaacaugcucuaccucgagaugaacucccuccgcgccgaggacaccgccgucuacuacugcgcccgcgaccacgacuuccgcuccggcuacgagggcugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15548 - RNA, 642 nt, Artificial Sequence
  derived and/or modified sequence opt2 from Enoticumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcaccgcuccaacuggccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15549 - RNA, 1329 nt, Artificial Sequence
  derived and/or modified sequence opt2 from Ensituximab_HeavyChain1
cagguccagcucaaggaguccggccccgaccucgucgcccccucccagucccucuccaucaccugcaccgucuccggcuucucccucuccaaguucggcgucaacuggguccgccagccccccggcaagggccucgaguggcucggcgucaucuggggcgacggcuccaccuccuacaacuccggccucaucucccgccucuccaucuccaaggagaacuccaagucccaggucuuccucaagcucaacucccuccaggccgacgacaccgccaccuacuacugcgucaagcccggcggcgacuacuggggccacggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccccuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaugccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15550 - RNA, 639 nt, Artificial Sequence
  derived and/or modified sequence opt2 from Ensituximab_LightChain1
caggucguccucacccagucccccgucaucauguccgccucccccggcgagaaggucaccaugaccugcuccgccuccuccuccaucuccuacauguacugguaccagcagaagcccggcaccucccccaagcgcuggaucuacgacaccuccaagcucgccuccggcguccccgcccgcuucuccggcuccggcuccggcaccuccuacucccucaccaucuccaacauggaggccggcgacgccgccaccuacuacugccaccagcgcgacuccuaccccuggaccuucggcggcggcaccaaccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15551 - RNA, 768 nt, Artificial Sequence; identical to SEQ ID NO: 15522
  derived and/or modified sequence opt2 from Ensituximab_SingleChain_variable_fragment

SEQ ID NO: 15552 - RNA, 987 nt, Artificial Sequence
  derived and/or modified sequence opt2 from Entolimod_chain1
augcgcggcucccaccaccaccaccaccacggcauggccuccaugaccggcggccagcagaugggccgcgaccucuacgacgacgacgacaaggaccccauggcccaggucaucaacaccaacucccucucccuccucacccagaacaaccucaacaagucccaguccucccucuccuccgccaucgagcgccucuccuccggccuccgcaucaacuccgccaaggacgacgccgccggccaggccaucgccaaccgcuucaccuccaacaucaagggccucacccaggccucccgcaacgccaacgacggcaucuccaucgcccagaccaccgagggcgcccucaacgagaucaacaacaaccuccagcgcguccgcgagcucuccguccaggccaccaacggcaccaacuccgacuccgaccucaaguccauccaggacgagauccagcagcgccucgaggagaucgaccgcgucuccaaccagacccaguucaacggcgucaagguccucucccaggacaaccagaugaagauccaggucggcgccaacgacggcgagaccaucaccaucgaccuccagaagaucgacgucaagucccucggccucgacggcuucaacgucaacucccccggcaucuccggcggcggcggcggcauccucgacuccaugggcacccucaucaacgaggacgccgccgccgccaagaaguccaccgccaacccccucgccuccaucgacuccgcccucuccaaggucgacgccguccgcuccucccucggcgccauccagaaccgcuucgacuccgccaucaccaaccucggcaacaccgucaccaaccucaacuccgcccgcucccgcaucgaggacgccgacuacgccaccgaggucuccaacauguccaaggcccagauccuccagcaggccggcaccuccguccucgcccaggccaaccaggucccccagaacguccucucccuccuccgc

SEQ ID NO: 15553 - RNA, 1338 nt, Artificial Sequence
  derived and/or modified sequence opt2 from Epratuzumab_HeavyChain
cagguccagcucguccaguccggcgccgaggucaagaagcccggcuccuccgucaaggucuccugcaaggccuccggcuacaccuucaccuccuacuggcuccacuggguccgccaggcccccggccagggccucgaguggaucggcuacaucaacccccgcaacgacuacaccgaguacaaccagaacuucaaggacaaggccaccaucaccgccgacgaguccaccaacaccgccuacauggagcucuccucccuccgcuccgaggacaccgccuucuacuucugcgcccgccgcgacaucaccaccuucuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15554 - RNA, 657 nt, Artificial Sequence
  derived and/or modified sequence opt2 from Epratuzumab_LightChain
gacauccagcucacccagucccccuccucccucuccgccuccgucggcgaccgcgucaccauguccugcaaguccucccaguccguccucuacuccgccaaccacaagaacuaccucgccugguaccagcagaagcccggcaaggcccccaagcuccucaucuacugggccuccacccgcgaguccggcguccccucccgcuucuccggcuccggcuccggcaccgacuucaccuucaccaucuccucccuccagcccgaggacaucgccaccuacuacugccaccaguaccucuccuccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15555 - RNA, 762 nt, Artificial Sequence
  derived and/or modified sequence opt2 from Eptacog_beta_HeavyChain1
aucgucggcggcaaggucugccccaagggcgagugccccuggcagguccuccuccucgucaacggcgcccagcucugcggcggcacccucaucaacaccaucugggucgucuccgccgcccacugcuucgacaagaucaagaacuggcgcaaccucaucgccguccucggcgagcacgaccucuccgagcacgacggcgacgagcagucccgccgcgucgcccaggucaucauccccuccaccuacguccccggcaccaccaaccacgacaucgcccuccuccgccuccaccagcccgucguccucaccgaccacgucgucccccucugccuccccgagcgcaccuucuccgagcgcacccucgccuucguccgcuucucccucgucuccggcuggggccagcuccucgaccgcggcgccaccgcccucgagcucaugguccucaacgucccccgccucaugacccaggacugccuccagcagucccgcaaggucggcgacucccccaacaucaccgaguacauguucugcgccggcuacuccgacggcuccaaggacuccugcaagggcgacuccggcggcccccacgccacccacuaccgcggcaccugguaccucaccggcaucgucuccuggggccagggcugcgccaccgucggccacuucggcgucuacacccgcgucucccaguacaucgaguggcuccagaagcucaugcgcuccgagccccgccccggcguccuccuccgcgcccccuucccc

SEQ ID NO: 15556 - RNA, 456 nt, Artificial Sequence
  derived and/or modified sequence opt2 from Eptacog_beta_LightChain1
gccaacgccuuccucgaggagcuccgccccggcucccucgagcgcgagugcaaggaggagcagugcuccuucgaggaggcccgcgagaucuucaaggacgccgagcgcaccaagcucuucuggaucuccuacuccgacggcgaccagugcgccuccucccccugccagaacggcggcuccugcaaggaccagcuccaguccuacaucugcuucugccuccccgccuucgagggccgcaacugcgagacccacaaggacgaccagcucaucugcgucaacgagaacggcggcugcgagcaguacugcuccgaccacaccggcaccaagcgcuccugccgcugccacgagggcuacucccuccucgccgacggcgucuccugcacccccaccgucgaguaccccugcggcaagauccccauccucgagaagcgcaacgccuccaagccccagggccgc

SEQ ID NO: 15557 - RNA, 708 nt, Artificial Sequence
  derived and/or modified sequence opt2 from Erlizuab_HeavyChain1
gagguccagcucgucgaguccggcggcggccucguccagcccggcggcucccuccgccucuccugcgccaccuccggcuacaccuucaccgaguacacccacuggcgccaggcccccggcaagggccucgagugggucgccggcaucaaccccaagaacggcggcaccucccacaaccagcgcuucgaccgcuucaccaucuccgucgacaaguccaccuccaccgccuaccagaacucccuccgcgccgaggacaccgccgucuacuacugcgcccgcuggcgcggccucaacuacggcuucgacguccgcuacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuc

SEQ ID NO: 15558 - RNA, 639 nt, Artificial Sequence
  derived and/or modified sequence opt2 from Erlizuab_LightChain1
gacauccagacccagucccccuccucccucuccgccuccgucggcgaccgcgucaccaucaccugccgcgccucccaggacaucaacaacuaccucaacugguaccagcagaagcccggcaaggcccccaagcuccucaucuacuacaccuccacccuccacuccggcguccccucccgcuucuccggcuccggcuccggcaccgacuacacccucaccaucuccucccuccagcccgaggacuucgccaccuacuacugccagcagggcaacacccucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15559 - RNA, 1341 nt, Artificial Sequence
  derived and/or modified sequence opt2 from Etaracizumab_HeavyChain1
cagguccagcucgucgaguccggcggcggcgucguccagcccggccgcucccuccgccucuccugcgccgccuccggcuucaccuucuccuccuacgacauguccuggguccgccaggcccccggcaagggccucgagugggucgccaaggucuccuccggcggcggcuccaccuacuaccucgacaccguccagggccgcuucaccaucucccgcgacaacuccaagaacacccucuaccuccagaugaacucccuccgcgccgaggacaccgccgucuacuacugcgcccgccaccuccacggcuccuucgccuccuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15560 - RNA, 642 nt, Artificial Sequence
  derived and/or modified sequence opt2 from Etaracizumab_LightChain1
gagaucguccucacccagucccccgccacccucucccucucccccggcgagcgcgccacccucuccugccaggccucccaguccaucuccaacuuccuccacugguaccagcagcgccccggccaggccccccgccuccucauccgcuaccgcucccaguccaucuccggcauccccgcccgcuucuccggcuccggcuccggcaccgacuucacccucaccaucuccucccucgagcccgaggacuucgccgucuacuacugccagcaguccggcuccuggccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15561 - RNA, 1326 nt, Artificial Sequence
  derived and/or modified sequence opt2 from Etrolizuab_HeavyChain1
gagguccagcucgucgaguccggcggcggccucguccagcccggcggcucccuccgccucuccugcgccgccuccggcuucuucaucaccaacaacuacuggggcuggguccgccaggcccccggcaagggccucgagugggucggcuacaucuccuacuccggcuccaccuccuacaaccccucccucaagucccgcuucaccaucucccgcgacaccuccaagaacaccuucuaccuccagaacucccuccgcgccgaggacaccgccgucuacuacugcgcccgcaccggcuccuccggcuacuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15562 - RNA, 1326 nt, Artificial Sequence
  derived and/or modified sequence opt2 from Etrolizuab_HeavyChain2
gagguccagcucgucgaguccggcggcggccucguccagcccggcggcucccuccgccucuccugcgccgccuccggcuucuucaucaccaacaacuacuggggcuggguccgccaggcccccggcaagggccucgagugggucggcuacaucuccuacuccggcuccaccuccuacaaccccuccaagcucucccgcuucaccaucucccgcgacaccuccaagaacaccuucuaccuccagaacucccuccgcgccgaggacaccgccgucuacuacugcgcccgcaccggcuccuccggcuacuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15563 - RNA, 639 nt, Artificial Sequence
  derived and/or modified sequence opt2 from Etrolizuab_LightChain1
gacauccagacccagucccccuccucccucuccgccuccgucggcgaccgcgucaccaucaccugccgcgccuccgaguccgucgacgaccuccuccacugguaccagcagaagcccggcaaggcccccaagcuccucaucaaguacgccucccaguccaucuccggcguccccucccgcuucuccggcuccggcuccggcaccgacuucacccucaccaucuccucccuccagcccgaggacuucgccaccuacuacugccagcagggcaacucccuccccaacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15564 - RNA, 1338 nt, Artificial Sequence
  derived and/or modified sequence opt2 from Etrolizumab_HeavyChain1
gagguccagcucgucgaguccggcggcggccucguccagcccggcggcucccuccgccucuccugcgccgccuccggcuucuucaucaccaacaacuacuggggcuggguccgccaggcccccggcaagggccucgagugggucggcuacaucuccuacuccggcuccaccuccuacaaccccucccucaagucccgcuucaccaucucccgcgacaccuccaagaacaccuucuaccuccagaugaacucccuccgcgccgaggacaccgccgucuacuacugcgcccgcaccggcuccuccggcuacuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15565 - RNA, 642 nt, Artificial Sequence
  derived and/or modified sequence opt2 from Etrolizumab_LightChain1
gacauccagaugacccagucccccuccucccucuccgccuccgucggcgaccgcgucaccaucaccugccgcgccuccgaguccgucgacgaccuccuccacugguaccagcagaagcccggcaaggcccccaagcuccucaucaaguacgccucccaguccaucuccggcguccccucccgcuucuccggcuccggcuccggcaccgacuucacccucaccaucuccucccuccagcccgaggacuucgccaccuacuacugccagcagggcaacucccuccccaacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15566 - RNA, 1359 nt, Artificial Sequence
  derived and/or modified sequence opt2 from Evinacumab_HeavyChain1
gagguccagcucgucgaguccggcggcggcgucauccagcccggcggcucccuccgccucuccugcgccgccuccggcuucaccuucgacgacuacgccaugaacuggguccgccagggccccggcaagggccucgagugggucuccgccaucuccggcgacggcggcuccaccuacuacgccgacuccgucaagggccgcuucaccaucucccgcgacaacuccaagaacucccucuaccuccagaugaacucccuccgcgccgaggacaccgccuucuucuacugcgccaaggaccuccgcaacaccaucuucggcgucgucauccccgacgccuucgacaucuggggccagggcaccauggucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15567 - RNA, 642 nt, Artificial Sequence
  derived and/or modified sequence opt2 from Evinacumab_LightChain1
gacauccagaugacccagucccccuccacccucuccgccuccgucggcgaccgcgucaccaucaccugccgcgccucccaguccauccgcuccuggcucgccugguaccagcagaagcccggcaaggcccccaagcuccucaucuacaaggccuccucccucgaguccggcguccccucccgcuucuccggcuccggcuccggcaccgaguucacccucaccaucuccucccuccagcccgacgacuucgccaccuacuacugccagcaguacaacuccuacuccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15568 - RNA, 1323 nt, Artificial Sequence
  derived and/or modified sequence opt2 from Evolocumab_HeavyChain1
gagguccagcucguccaguccggcgccgaggucaagaagcccggcgccuccgucaaggucuccugcaaggccuccggcuacacccucaccuccuacggcaucuccuggguccgccaggcccccggccagggccucgaguggaugggcugggucuccuucuacaacggcaacaccaacuacgcccagaagcuccagggccgcggcaccaugaccaccgaccccuccaccuccaccgccuacauggagcuccgcucccuccgcuccgacgacaccgccgucuacuacugcgcccgcggcuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15569 - RNA, 645 nt, Artificial Sequence
  derived and/or modified sequence opt2 from Evolocumab_LightChain1
gaguccgcccucacccagcccgccuccgucuccggcucccccggccaguccaucaccaucuccugcaccggcaccuccuccgacgucggcggcuacaacuccgucuccugguaccagcagcaccccggcaaggcccccaagcucaugaucuacgaggucuccaaccgccccuccggcgucuccaaccgcuucuccggcuccaaguccggcaacaccgccucccucaccaucuccggccuccaggccgaggacgaggccgacuacuacugcaacuccuacaccuccaccuccauggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15570 - RNA, 1353 nt, Artificial Sequence
  derived and/or modified sequence opt2 from Exbivirumab_HeavyChain1
cagguccagcucgucgaguccggcggcggcgucguccagcccggcggcucccuccgccucuccugcgcccccuccggcuucgucuuccgcuccuacggcaugcacuggguccgccagacccccggcaagggccucgagugggucucccucaucuggcacgacggcuccaaccgcuucuacgccgacuccgucaagggccgcuucaccaucucccgcgacaacuccaagaacacccucuaccuccagaugaacucccuccgcgccgaggacaccgccauguacuucugcgcccgcgagcgccucaucgccgcccccgccgccuucgaccucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15571 - RNA, 642 nt, Artificial Sequence
  derived and/or modified sequence opt2 from Exbivirumab_LightChain1
uccuacguccucacccagccccccuccgucuccgucgcccccggcaagaccgcccgcaucuccugcggcggcaacaacaucggcaccaagaacguccacugguaccagcagaagcccggccaggcccccguccucgucgucuacgccgacuccgaccgccccuccggcauccccgagcgcuucuccggcuccaacuccggcaacaccgccacccucaccaucucccgcgucgaggccggcgacgaggccgacuacuacugccaggucugggacuccgucuccuaccacgucgucuucggcggcggcaccacccucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15572 - RNA, 1347 nt, Artificial Sequence
  derived and/or modified sequence opt2 from Farletuzumab_HeavyChain1
gagguccagcucgucgaguccggcggcggcgucguccagcccggccgcucccuccgccucuccugcuccgccuccggcuucaccuucuccggcuacggccucuccuggguccgccaggcccccggcaagggccucgagugggucgccaugaucuccuccggcggcuccuacaccuacuacgccgacuccgucaagggccgcuucgccaucucccgcgacaacgccaagaacacccucuuccuccagauggacucccuccgccccgaggacaccggcgucuacuucugcgcccgccacggcgacgaccccgccugguucgccuacuggggccagggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15573 - RNA, 651 nt, Artificial Sequence
  derived and/or modified sequence opt2 from Farletuzumab_LightChain1
gacauccagcucacccagucccccuccucccucuccgccuccgucggcgaccgcgucaccaucaccugcuccgucuccuccuccaucuccuccaacaaccuccacugguaccagcagaagcccggcaaggcccccaagcccuggaucuacggcaccuccaaccucgccuccggcguccccucccgcuucuccggcuccggcuccggcaccgacuacaccuucaccaucuccucccuccagcccgaggacaucgccaccuacuacugccagcagugguccuccuaccccuacauguacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15574 - RNA, 1338 nt, Artificial Sequence
  derived and/or modified sequence opt2 from Fasinumab_HeavyChain1
cagguccagcucguccaguccggcgccgaggucaagaagcccggcgccuccgucaaggucuccugcaaggucuccggcuucacccucaccgagcucuccauccacuggguccgccaggcccccggcaagggccucgaguggaugggcggcuucgaccccgaggacggcgagaccaucuacgcccagaaguuccagggccgcgucaccaugaccgaggacaccuccaccgacaccgccuacauggagcucaccucccuccgcuccgaggacaccgccgucuacuacugcuccaccaucuucggcgucgucaccaacuucgacaacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15575 - RNA, 642 nt, Artificial Sequence
  derived and/or modified sequence opt2 from Fasinumab_LightChain1
gacauccagaugacccagucccccuccucccucuccgccuccgccggcgaccgcgucaccaucaccugccgcgccucccaggccauccgcaacgaccucggcugguaccagcagaagcccggcaaggcccccaagcgccucaucuacgccgccuucaaccuccaguccggcguccccucccgcuucuccggcuccggcuccggcaccgaguucacccucaccaucuccucccuccagcccgaggaccucgccuccuacuacugccagcaguacaaccgcuaccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15576 - RNA, 1350 nt, Artificial Sequence
  derived and/or modified sequence opt2 from Fezakinumab_HeavyChain1
cagguccagcucguccaguccggcgccgaggucaagaagcccggcgccuccgucaaggucuccugcaaggccuccggcuacaccuucaccaacuacuacaugcacuggguccgccaggcccccggccagggccucgagugggucggcuggaucaaccccuacaccggcuccgccuucuacgcccagaaguuccgcggccgcgucaccaugacccgcgacaccuccaucuccaccgccuacauggagcucucccgccuccgcuccgacgacaccgccgucuacuacugcgcccgcgagcccgagaaguucgacuccgacgacuccgacgucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15577 - RNA, 651 nt, Artificial Sequence
  derived and/or modified sequence opt2 from Fezakinumab_LightChain1
caggccguccucacccagccccccuccgucuccggcgcccccggccagcgcgucaccaucuccugcaccggcuccuccuccaacaucggcgccggcuacggcguccacugguaccagcagcuccccggcaccgcccccaagcuccucaucuacggcgacuccaaccgccccuccggcguccccgaccgcuucuccggcuccaaguccggcaccuccgccucccucgccaucaccggccuccaggccgaggacgaggccgacuacuacugccaguccuacgacaacucccucuccggcuacgucuucggcggcggcacccagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15578 - RNA, 1347 nt, Artificial Sequence
  derived and/or modified sequence opt2 from FG-3019_HeavyChain1
gagggccagcucguccaguccggcggcggccucguccaccccggcggcucccuccgccucuccugcgccggcuccggcuucaccuucuccuccuacggcaugcacuggguccgccaggcccccggcaagggccucgagugggucuccggcaucggcaccggcggcggcaccuacuccaccgacuccgucaagggccgcuucaccaucucccgcgacaacgccaagaacucccucuaccuccagaugaacucccuccgcgccgaggacauggccgucuacuacugcgcccgcggcgacuacuacggcuccggcuccuucuucgacugcuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15579 - RNA, 642 nt, Artificial Sequence
  derived and/or modified sequence opt2 from FG-3019_LightChain1
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuacccccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15580 - RNA, 1344 nt, Artificial Sequence
  derived and/or modified sequence opt2 from Fibatuzumab_HeavyChain1
cagguccagcucguccaguccggcgccgaggucaagaagcccggcgccuccgucaaggucuccugcaaggccuccggcuacaccuucaccggcuacuggaugaacuggguccgccaggcccccggccagggccucgaguggaugggcgacaucuaccccggcuccggcaacaccaacuacgacgagaaguuccagggccgcgucaccaugacccgcgacaccuccaucuccaccgccuacauggagcucucccgccuccgcuccgacgacaccgccgucuacuacugcgcccgcggcggcuacuacgaggacuucgacuccuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15581 - RNA, 642 nt, Artificial Sequence
  derived and/or modified sequence opt2 from Fibatuzumab_LightChain1
gacauccagaugacccagucccccuccuuccucuccgccuccgucggcgaccgcgucaccaucaccugccgcgccucccagggcaucaucuccuaccucgccugguaccagcagaagcccgagaaggcccccaagcgccucaucuacgccgccuccucccuccaguccggcguccccucccgcuucuccggcuccggcuccggcaccgaguucacccucaccaucuccucccuccagcccgaggacuucgccaccuacuacugcggccaguacgccaacuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15582 - RNA, 1344 nt, Artificial Sequence
  derived and/or modified sequence opt2 from Ficlatuzumab_HeavyChain1
cagguccagcucguccagcccggcgccgaggucaagaagcccggcaccuccgucaagcucuccugcaaggccuccggcuacaccuucaccaccuacuggaugcacuggguccgccaggcccccggccagggccucgaguggaucggcgagaucaaccccaccaacggccacaccaacuacaaccagaaguuccagggccgcgccacccucaccgucgacaaguccaccuccaccgccuacauggagcucuccucccuccgcuccgaggacaccgccgucuacuacugcgcccgcaacuacgucggcuccaucuucgacuacuggggccagggcacccuccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15583 - RNA, 1341 nt, Artificial Sequence
  derived and/or modified sequence opt2 from Ficlatuzumab_HeavyChain
guccagcucguccagcccggcgccgaggucaagaagcccggcaccuccgucaagcucuccugcaaggccuccggcuacaccuucaccaccuacuggaugcacuggguccgccaggcccccggccagggccucgaguggaucggcgagaucaaccccaccaacggccacaccaacuacaaccagaaguuccagggccgcgccacccucaccgucgacaaguccaccuccaccgccuacauggagcucuccucccuccgcuccgaggacaccgccgucuacuacugcgcccgcaacuacgucggcuccaucuucgacuacuggggccagggcacccuccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15584 - RNA, 642 nt, Artificial Sequence
  derived and/or modified sequence opt2 from Ficlatuzumab_LightChain1
gacaucgucaugacccagucccccgacucccucgccaugucccucggcgagcgcgucacccucaacugcaaggccuccgagaacgucgucuccuacgucuccugguaccagcagaagcccggccagucccccaagcuccucaucuacggcgccuccaaccgcgaguccggcguccccgaccgcuucuccggcuccggcuccgccaccgacuucacccucaccaucuccuccguccaggccgaggacgucgccgacuaccacugcggccaguccuacaacuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15585 - RNA, 1350 nt, Artificial Sequence
  derived and/or modified sequence opt2 from Figitumumab_HeavyChain1
gagguccagcuccucgaguccggcggcggccucguccagcccggcggcucccuccgccucuccugcaccgccuccggcuucaccuucuccuccuacgccaugaacuggguccgccaggcccccggcaagggccucgagugggucuccgccaucuccggcuccggcggcaccaccuucuacgccgacuccgucaagggccgcuucaccaucucccgcgacaacucccgcaccacccucuaccuccagaugaacucccuccgcgccgaggacaccgccgucuacuacugcgccaaggaccucggcugguccgacuccuacuacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15586 - RNA, 642 nt, Artificial Sequence
  derived and/or modified sequence opt2 from Figitumumab_LightChain1
gacauccagaugacccaguuccccuccucccucuccgccuccgucggcgaccgcgucaccaucaccugccgcgccucccagggcauccgcaacgaccucggcugguaccagcagaagcccggcaaggcccccaagcgccucaucuacgccgccucccgccuccaccgcggcguccccucccgcuucuccggcuccggcuccggcaccgaguucacccucaccaucuccucccuccagcccgaggacuucgccaccuacuacugccuccagcacaacuccuaccccugcuccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15587 - RNA, 1359 nt, Artificial Sequence
  derived and/or modified sequence opt2 from Firivumab_HeavyChain1
cagguccagcucguccaguccggcgccgaggucaagaugcccggcuccuccgucaaggucuccugcaagaccuccggcgucuucuucuccucccacgccaucuccuggguccgccaggcccccggccagggccucgaguggaugggcggcaucucccccauguucggcaccacccacuacgcccagaaguuccagggccgcgucaccaucaccgccgaccaguccaccaccaccgccuacauggagcucaccucccucaccuccgaggacaccgccgucuacuacugcgcccgcgacggcgccggcuccuacuacccccucaacugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 15588 - RNA, 642 nt, Artificial Sequence
  derived and/or modified sequence opt2 from Firivumab_LightChain1
gagaucguccucacccagucccccgccacccucucccucucccccggcgagcgcgccacccucuccugccgcgccuccgagaacaucuggaacaaccucgccugguaccagcagaagcccggccaggccccccgccuccucaucuccggcgccuccaccggcgccaccggcguccccucccgcuuccgcggcuccggcucccgcaccgaguucacccucaccaucuccucccuccaguccgaggacuucgccaucuacuucugccagcaguacaacuccuggccccgcaccuucggccccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15589 - RNA, 1347 nt, Artificial Sequence
  derived and/or modified sequence opt2 from Flanvotumab_HeavyChain1
cagguccagcucguccaguccggcuccgagcucaagaagcccggcgccuccgucaagaucuccugcaaggccuccggcuacaccuucaccuccuacgccaugaacuggguccgccaggcccccggccagggccucgaguccaugggcuggaucaacaccaacaccggcaaccccaccuacgcccagggcuucaccggccgcuucgucuucuccauggacaccuccgucuccaccgccuaccuccagaucuccucccucaaggccgaggacaccgccaucuacuacugcgccccccgcuacuccuccuccugguaccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15590 - RNA, 645 nt, Artificial Sequence
  derived and/or modified sequence opt2 from Flanvotumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcucauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15591 - RNA, 1362 nt, Artificial Sequence
  derived and/or modified sequence opt2 from Fletikumab_HeavyChain1
cagguccagcucguccaguccggcgccgaggucaagcgccccggcgccuccgucaaggucuccugcaaggccuccggcuacaccuucaccaacgacaucauccacuggguccgccaggcccccggccagcgccucgaguggaugggcuggaucaacgccggcuacggcaacacccaguacucccagaacuuccaggaccgcgucuccaucacccgcgacaccuccgccuccaccgccuacauggagcucaucucccuccgcuccgaggacaccgccgucuacuacugcgcccgcgagccccucugguucggcgaguccuccccccacgacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15592 - RNA, 642 nt, Artificial Sequence
  derived and/or modified sequence opt2 from Fletikumab_LightChain1
gccauccagcucacccagucccccuccucccucuccgccuccgucggcgaccgcgucaccaucaccugccgcgccucccagggcaucuccuccgcccucgccugguaccagcagaagcccggcaaggcccccaagcuccucaucuacgacgccuccucccucgaguccggcguccccucccgcuucuccggcuccggcuccggcaccgacuucacccucaccaucuccucccuccagcccgaggacuucgccaccuacuacugccagcaguucaacuccuacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15593 - RNA, 1341 nt, Artificial Sequence
  derived and/or modified sequence opt2 from Fontolizumab_HeavyChain1
cagguccagcucguccaguccggcgccgagcucaagaagcccggcuccuccgucaaggucuccugcaaggccuccggcuacaucuucaccuccuccuggaucaacugggucaagcaggcccccggccagggccucgaguggaucggccgcaucgaccccuccgacggcgagguccacuacaaccaggacuucaaggacaaggccacccucaccgucgacaaguccaccaacaccgccuacauggagcucuccucccuccgcuccgaggacaccgccgucuacuacugcgcccgcggcuuccuccccugguucgccgacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15594 - RNA, 642 nt, Artificial Sequence
  derived and/or modified sequence opt2 from Fontolizumab_LightChain1
gacauccagaugacccagucccccuccacccucuccgccuccgucggcgaccgcgucaccaucaccugcaaggccuccgagaacgucgacaccuacgucuccugguaccagcagaagcccggcaaggcccccaagcuccucaucuacggcgccuccaaccgcuacaccggcguccccucccgcuucuccggcuccggcuccggcaccgacuucacccucaccaucuccucccuccagcccgacgacuucgccaccuacuacugcggccaguccuacaacuaccccuucaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15595 - RNA, 1344 nt, Artificial Sequence
  derived and/or modified sequence opt2 from Foralumab_HeavyChain1
cagguccagcucgucgaguccggcggcggcgucguccagcccggccgcucccuccgccucuccugcgccgccuccggcuucaaguucuccggcuacggcaugcacuggguccgccaggcccccggcaagggccucgagugggucgccgucaucugguacgacggcuccaagaaguacuacgucgacuccgucaagggccgcuucaccaucucccgcgacaacuccaagaacacccucuaccuccagaugaacucccuccgcgccgaggacaccgccgucuacuacugcgcccgccagaugggcuacuggcacuucgaccucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgagggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15596 - RNA, 645 nt, Artificial Sequence
  derived and/or modified sequence opt2 from Foralumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15597 - RNA, 1344 nt, Artificial Sequence
  derived and/or modified sequence opt2 from Foravirumab_HeavyChain1
cagguccagcucgucgaguccggcggcggcgccguccagcccggccgcucccuccgccucuccugcgccgccuccggcuucaccuucuccuccuacggcaugcacuggguccgccaggcccccggcaagggccucgagugggucgccgucauccucuacgacggcuccgacaaguucuacgccgacuccgucaagggccgcuucaccaucucccgcgacaacuccaagaacacccucuaccuccagaugaacucccuccgcgccgaggacaccgccgucuacuacugcgccaaggucgccgucgccggcacccacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15598 - RNA, 1344 nt, Artificial Sequence
  derived and/or modified sequence opt2 from Foravirumab_HeavyChain
gagguccagcucgucgaguccggcggcggcgccguccagcccggccgcucccuccgccucuccugcgccgccuccggcuucaccuucuccuccuacggcaugcacuggguccgccaggcccccggcaagggccucgagugggucgccgucauccucuacgacggcuccgacaaguucuacgccgacuccgucaagggccgcuucaccaucucccgcgacaacuccaagaacacccucuaccuccagaugaacucccuccgcgccgaggacaccgccgucuacuacugcgccaaggucgccgucgccggcacccacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15599 - RNA, 642 nt, Artificial Sequence
  derived and/or modified sequence opt2 from Foravirumab_LightChain1
gacauccagaugacccagucccccuccucccucuccgccuccgucggcgaccgcgucaccaucaccugccgcgccucccagggcauccgcaacgaccucggcugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcagcucaacuccuacccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15600 - RNA, 1341 nt, Artificial Sequence
  derived and/or modified sequence opt2 from Fresolimumab_HeavyChain1
cagguccagcucguccaguccggcgccgaggucaagaagcccggcuccuccgucaaggucuccugcaaggccuccggcuacaccuucuccuccaacgucaucuccuggguccgccaggcccccggccagggccucgaguggaugggcggcgucauccccaucgucgacaucgccaacuacgcccagcgcuucaagggccgcgucaccaucaccgccgacgaguccaccuccaccaccuacauggagcucuccucccuccgcuccgaggacaccgccgucuacuacugcgccuccacccucggccucguccucgacgccauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15601 - RNA, 645 nt, Artificial Sequence
  derived and/or modified sequence opt2 from Fresolimumab_LightChain1
gagaccguccucacccagucccccggcacccucucccucucccccggcgagcgcgccacccucuccugccgcgccucccagucccucggcuccuccuaccucgccugguaccagcagaagcccggccaggccccccgccuccucaucuacggcgccuccucccgcgcccccggcauccccgaccgcuucuccggcuccggcuccggcaccgacuucacccucaccaucucccgccucgagcccgaggacuucgccgucuacuacugccagcaguacgccgacucccccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15602 - RNA, 1347 nt, Artificial Sequence
  derived and/or modified sequence opt2 from Fulranumab_HeavyChain1
gagguccagcucgucgaguccggcggcggccucguccagcccggcggcucccuccgccucuccugcgccgccuccggcuucacccuccgcuccuacuccaugaacuggguccgccaggcccccggcaagggccucgagugggucuccuacaucucccgcuccucccacaccaucuucuacgccgacuccgucaagggccgcuucaccaucucccgcgacaacgccaagaacucccucuaccuccagauggacucccuccgcgacgaggacaccgccauguacuacugcgcccgcgucuacuccuccggcuggcacgucuccgacuacuucgacuacuggggccagggcauccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15603 - RNA, 642 nt, Artificial Sequence; identical to SEQ ID NO: 15592
  derived and/or modified sequence opt2 from Fulranumab_LightChain1

SEQ ID NO: 15604 - RNA, 1356 nt, Artificial Sequence
  derived and/or modified sequence opt2 from Futuximab_HeavyChain1
gagguccagcuccagcagcccggcuccgagcucguccgccccggcgccuccgucaagcucuccugcaaggccuccggcuacaccuucaccuccuacuggaugcacugggucaagcagcgccccggccagggccucgaguggaucggcaacaucuaccccggcucccgcuccaccaacuacgacgagaaguucaaguccaaggccacccucaccgucgacaccuccuccuccaccgccuacaugcagcucuccucccucaccuccgaggacuccgccgucuacuacugcacccgcaacggcgacuacuacgucuccuccggcgacgccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15605 - RNA, 642 nt, Artificial Sequence
  derived and/or modified sequence opt2 from Futuximab_LightChain1
gacauccagaugacccagaccaccuccucccucuccgccucccucggcgaccgcgucaccaucuccugccgcaccucccaggacaucggcaacuaccucaacugguaccagcagaagcccgacggcaccgucaagcuccucaucuacuacaccucccgccuccacuccggcguccccucccgcuucuccggcuccggcuccggcaccgacuucucccucaccaucaacaacgucgagcaggaggacgucgccaccuacuucugccagcacuacaacaccgucccccccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15606 - RNA, 1335 nt, Artificial Sequence
  derived and/or modified sequence opt2 from Galcanezumab_HeavyChain1
cagguccagcucguccaguccggcgccgaggucaagaagcccggcuccuccgucaaggucuccugcaaggccuccggcuacaccuucggcaacuacuggaugcaguggguccgccaggcccccggccagggccucgaguggaugggcgccaucuacgagggcaccggcaagaccgucuacauccagaaguucgccgaccgcgucaccaucaccgccgacaaguccaccuccaccgccuacauggagcucuccucccuccgcuccgaggacaccgccgucuacuacugcgcccgccucuccgacuacgucuccggcuucggcuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaggccgccggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15607 - RNA, 642 nt, Artificial Sequence
  derived and/or modified sequence opt2 from Galcanezumab_LightChain1
gacauccagaugacccagucccccuccucccucuccgccuccgucggcgaccgcgucaccaucaccugccgcgccuccaaggacaucuccaaguaccucaacugguaccagcagaagcccggcaaggcccccaagcuccucaucuacuacaccuccggcuaccacuccggcguccccucccgcuucuccggcuccggcuccggcaccgacuucacccucaccaucuccucccuccagcccgaggacuucgccaccuacuacugccagcagggcgacgcccucccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15608 - RNA, 1371 nt, Artificial Sequence
  derived and/or modified sequence opt2 from Galiximab_HeavyChain1
cagguccagcuccaggaguccggccccggccucgucaagcccuccgagacccucucccucaccugcgccgucuccggcggcuccaucuccggcggcuacggcuggggcuggauccgccagccccccggcaagggccucgaguggaucggcuccuucuacuccuccuccggcaacaccuacuacaaccccucccucaagucccaggucaccaucuccaccgacaccuccaagaaccaguucucccucaagcucaacuccaugaccgccgccgacaccgccgucuacuacugcguccgcgaccgccucuucuccgucgucggcauggucuacaacaacugguucgacgucuggggccccggcguccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15609 - RNA, 648 nt, Artificial Sequence
  derived and/or modified sequence opt2 from Galiximab_LightChain1
gaguccgcccucacccagccccccuccgucuccggcgcccccggccagaaggucaccaucuccugcaccggcuccaccuccaacaucggcggcuacgaccuccacugguaccagcagcuccccggcaccgcccccaagcuccucaucuacgacaucaacaagcgccccuccggcaucuccgaccgcuucuccggcuccaaguccggcaccgccgccucccucgccaucaccggccuccagaccgaggacgaggccgacuacuacugccaguccuacgacuccucccucaacgcccaggucuucggcggcggcacccgccucaccguccucggccagcccaaggccgcccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15610 - RNA, 1347 nt, Artificial Sequence
  derived and/or modified sequence opt2 from Ganitumab_HeavyChain1
cagguccagcuccaggaguccggccccggccucgucaagcccuccggcacccucucccucaccugcgccgucuccggcggcuccaucuccuccuccaacuggugguccuggguccgccagccccccggcaagggccucgaguggaucggcgagaucuaccacuccggcuccaccaacuacaaccccucccucaagucccgcgucaccaucuccgucgacaaguccaagaaccaguucucccucaagcucuccuccgucaccgccgccgacaccgccgucuacuacugcgcccgcuggaccggccgcaccgacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15611 - RNA, 657 nt, Artificial Sequence
  derived and/or modified sequence opt2 from Ganitumab_LightChain1
gacgucgucaugacccaguccccccucucccuccccgucacccccggcgagcccgccuccaucuccugccgcuccucccagucccuccuccacuccaacggcuacaacuaccucgacugguaccuccagaagcccggccaguccccccagcuccucaucuaccucggcuccaaccgcgccuccggcguccccgaccgcuucuccggcuccggcuccggcaccgacuucacccucaagaucucccgcgucgaggccgaggacgucggcgucuacuacugcaugcagggcacccacuggccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15612 - RNA, 1368 nt, Artificial Sequence
  derived and/or modified sequence opt2 from Gantenerumab_HeavyChain1
caggucgagcucgucgaguccggcggcggccucguccagcccggcggcucccuccgccucuccugcgccgccuccggcuucaccuucuccuccuacgccauguccuggguccgccaggcccccggcaagggccucgagugggucuccgccaucaacgccuccggcacccgcaccuacuacgccgacuccgucaagggccgcuucaccaucucccgcgacaacuccaagaacacccucuaccuccagaugaacucccuccgcgccgaggacaccgccgucuacuacugcgcccgcggcaagggcaacacccacaagcccuacggcuacguccgcuacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15613 - RNA, 645 nt, Artificial Sequence
  derived and/or modified sequence opt2 from Gantenerumab_LightChain1
gacaucguccucacccagucccccgccacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcguccccgcccgcuucuccggcuccggcuccggcaccgacuucacccucaccaucuccucccucgagcccgaggacuucgccaccuacuacugccuccagaucuacaacaugcccaucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15614 - RNA, 348 nt, Artificial Sequence
  derived and/or modified sequence opt2 from Gemtuzumab_HeavyChain1
cagguccagcuccagcaguccggcgccgagcucgccaagcccggcgccuccgucaagauguccugcaaggccuccggcuacaccuucaccuccuaccgcaugcacugggucaagcagcgccccggccagggccucgaguggaucggcuacaucaaccccuccaccggcuacaccgaguacaaccagaaguucaaggacaaggccacccucaccgccgacaaguccuccuccaccgccuacaugcagcucuccucccucaccuucgaggacuccgccgucuacuacugcgcccgcggcggcggcgucuucgacuacuggggccagggcaccacccucaccgucuccucc

SEQ ID NO: 15615 - RNA, 351 nt, Artificial Sequence
  derived and/or modified sequence opt2 from Gemtuzumab_HeavyChain2
cagguccagcucguccaguccggcgccgaggucaagaagcccggcuccuccgucaaggucuccugcaaggccuccggcggcaccuucucccgcuccgccaucaucuggguccgccaggcccccggccagggccucgaguggaugggcggcaucguccccauguucggcccccccaacuacgcccagaaguuccagggccgcgucaccaucaccgccgacgaguccaccaacaccgccuacauggagcucuccucccuccgcuccgaggacaccgccuucuacuucugcgccggcggcuacggcaucuacucccccgaggaguacaacggcggccucgucaccgucuccucc

SEQ ID NO: 15616 - RNA, 321 nt, Artificial Sequence
  derived and/or modified sequence opt2 from Gemtuzumab_LightChain2
gacauccagaugacccagucccccuccacccucuccgccuccgucggcgaccgcgucaccaucaccugccgcgccucccaguccaucaacaccuggcucgccugguaccagcagaagcccggcaaggcccccaagcuccucauguacaaggccuccucccucgaguccggcguccccucccgcuucaucggcuccggcuccggcaccgaguucacccucaccaucuccucccuccagcccgacgacuucgccaccuacuacugccagcaguacaacuccgacuccaagauguucggccagggcaccaaggucgaggucaag

SEQ ID NO: 15617 - RNA, 318 nt, Artificial Sequence
  derived and/or modified sequence opt2 from Gemtuzumab_ozogamicin_LightChain1
cagaucguccucacccagucccccgccaucauguccgccucccccggcgagaaggucaccaucaccugcuccgccuccuccuccaucuccuacaugcacugguuccagcagaagcccggcaccucccccaagcucuggaucuacaccaccuccaaccucgccuccggcguccccgcccgcuucuccggcuccggcuccggcaccuccuacucccucaccaucucccgcauggaggccgaggacgccgccaccuacuacugccaccagcgcuccaccuacccccucaccuucggcuccggcaccaagcucgagcucaag

SEQ ID NO: 15618 - RNA, 1335 nt, Artificial Sequence
  derived and/or modified sequence opt2 from Gevokizumab_HeavyChain1
cagguccagcuccaggaguccggccccggccucgucaagcccucccagacccucucccucaccugcuccuucuccggcuucucccucuccaccuccggcaugggcgucggcuggauccgccagcccuccggcaagggccucgaguggcucgcccacaucuggugggacggcgacgaguccuacaaccccucccucaagucccgccucaccaucuccaaggacaccuccaagaaccaggucucccucaagaucaccuccgucaccgccgccgacaccgccgucuacuucugcgcccgcaaccgcuacgacccccccugguucgucgacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccgucaccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15619 - RNA, 642 nt, Artificial Sequence
  derived and/or modified sequence opt2 from Gevokizumab_LightChain1
gacauccagaugacccaguccaccuccucccucuccgccuccgucggcgaccgcgucaccaucaccugccgcgccucccaggacaucuccaacuaccucuccugguaccagcagaagcccggcaaggccgucaagcuccucaucuacuacaccuccaagcuccacuccggcguccccucccgcuucuccggcuccggcuccggcaccgacuacacccucaccaucuccucccuccagcaggaggacuucgccaccuacuucugccuccagggcaagaugcuccccuggaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15620 - RNA, 1347 nt, Artificial Sequence
  derived and/or modified sequence opt2 from Girentuximab_HeavyChain1
gacgucaagcucgucgaguccggcggcggccucgucaagcucggcggcucccucaagcucuccugcgccgccuccggcuucaccuucuccaacuacuacauguccuggguccgccagacccccgagaagcgccucgagcucgucgccgccaucaacuccgacggcggcaucaccuacuaccucgacaccgucaagggccgcuucaccaucucccgcgacaacgccaagaacacccucuaccuccagauguccucccucaaguccgaggacaccgcccucuucuacugcgcccgccaccgcuccggcuacuucuccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15621 - RNA, 642 nt, Artificial Sequence
  derived and/or modified sequence opt2 from Girentuximab_LightChain1
gacaucgucaugacccagucccagcgcuucauguccaccaccgucggcgaccgcgucuccaucaccugcaaggccucccagaacgucgucuccgccgucgccugguaccagcagaagcccggccagucccccaagcuccucaucuacuccgccuccaaccgcuacaccggcguccccgaccgcuucaccggcuccggcuccggcaccgacuucacccucaccaucuccaacaugcaguccgaggaccucgccgacuucuucugccagcaguacuccaacuaccccuggaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15622 - RNA, 1335 nt, Artificial Sequence
  derived and/or modified sequence opt2 from Glembatumumab_HeavyChain1
cagguccagcuccaggaguccggccccggccucgucaagcccucccagacccucucccucaccugcaccgucuccggcggcuccaucuccuccuucaacuacuacugguccuggauccgccaccaccccggcaagggccucgaguggaucggcuacaucuacuacuccggcuccaccuacuccaaccccucccucaagucccgcgucaccaucuccgucgacaccuccaagaaccaguucucccucacccucuccuccgucaccgccgccgacaccgccgucuacuacugcgcccgcggcuacaacuggaacuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15623 - RNA, 645 nt, Artificial Sequence
  derived and/or modified sequence opt2 from Glembatumumab_LightChain1
gagaucgucaugacccagucccccgccacccucuccgucucccccggcgagcgcgccacccucuccugccgcgccucccaguccgucgacaacaaccucgucugguaccagcagaagcccggccaggccccccgccuccucaucuacggcgccuccacccgcgccaccggcauccccgcccgcuucuccggcuccggcuccggcaccgaguucacccucaccaucuccucccuccaguccgaggacuucgccgucuacuacugccagcaguacaacaacuggccccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15624 - RNA, 1332 nt, Artificial Sequence
  derived and/or modified sequence opt2 from Goilixiab_HeavyChain1
gagguccagcucgucgaguccggcggcggccucgccaagcccggcggcucccuccgccucuccugcgccgccuccggcuuccgcuucaccuucaacaacuacuacgacuggguccgccaggcccccggccagggccucgagugggucucccgcaucuccuccuccggcgaccccaccugguacgccgacuccgucaagggccgcuucaccaucucccgcgagaacgccaagaacacccucuuccuccagaacucccuccgcgccgaggacaccgccgucuacuacugcgccucccucaccaccggcuccgacuccuggggccagggcguccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 15625 - RNA, 639 nt, Artificial Sequence
  derived and/or modified sequence opt2 from Goilixiab_LightChain1
gacauccagacccagucccccuccucccucuccgccuccgucggcgaccgcgucaccaucaccugccgcgccucccaggacauccgcuacuaccucaacugguaccagcagaagcccggcaaggcccccaagcuccucaucuacgucgccuccucccuccaguccggcguccccucccgcuucuccggcuccggcuccggcaccgaguucacccucaccgucuccucccuccagcccgaggacuucgccaccuacuacugccuccaggucuacuccaccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15626 - RNA, 1338 nt, Artificial Sequence
  derived and/or modified sequence opt2 from Guselkumab_HeavyChain1
gagguccagcucguccaguccggcgccgaggucaagaagcccggcgagucccucaagaucuccugcaagggcuccggcuacuccuucuccaacuacuggaucggcuggguccgccagaugcccggcaagggccucgaguggaugggcaucaucgaccccuccaacuccuacacccgcuacucccccuccuuccagggccaggucaccaucuccgccgacaaguccaucuccaccgccuaccuccagugguccucccucaaggccuccgacaccgccauguacuacugcgcccgcugguacuacaagcccuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15627 - RNA, 651 nt, Artificial Sequence
  derived and/or modified sequence opt2 from Guselkumab_LightChain1
caguccguccucacccagccccccuccgucuccggcgcccccggccagcgcgucaccaucuccugcaccggcuccuccuccaacaucggcuccggcuacgacguccacugguaccagcagcuccccggcaccgcccccaagcuccucaucuacggcaacuccaagcgccccuccggcguccccgaccgcuucuccggcuccaaguccggcaccuccgccucccucgccaucaccggccuccaguccgaggacgaggccgacuacuacugcgccuccuggaccgacggccucucccucgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15628 - RNA, 360 nt, Artificial Sequence
  derived and/or modified sequence opt2 from HuMab-001_HeavyChain_VDJ-Region
cagguccagcuccagcaguggggcgccggccuccucaagcccuccgagacccucucccucaccugcgccgucuacggcggcuccuucuccggcuacuacuggaacuggauccgccagccccccggcaagggccucgaguggaucggcgagaucaaccacuccggcuccaccaacuacaaccccucccucaagucccgcgucaccaucuccgucgacaccuccaagaaccaguucucccucaagcucuccuccgucaccgccgccgacaccgccgucuacuacugcgcccgcggcaacuacggcuccggcuacuacuacuucgaccucuggggccgcggcacccaggucaccgucuccucc

SEQ ID NO: 15629 - RNA, 321 nt, Artificial Sequence
  derived and/or modified sequence opt2 from HuMab-001_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuucgccgccuccucccuccaguccggcguccccucccgcuucuccggcuccggcuccggcaccgacuucacccucaccaucuccucccuccagcccgaggacuucgccaccuacuacugccagcaguacaucuccuuccccaucaccuucggccagggcacccgccucgagaucaag

SEQ ID NO: 15630 - RNA, 366 nt, Artificial Sequence
  derived and/or modified sequence opt2 from HuMab-005_HeavyChain_gamma-Chain_VDJ-Region
gagguccagcucguccaguccggcgccgaggucaagaagcccggcgagucccucaagaucuccugcaaggccuccggcuacuccuuccacuucuacuggaucggcuggguccgccagaugcccggcaagggccucgaguggaugggcuccaucuaccccggcgacuccgacacccgcuaccgccccuccuuccagggccaggucaccaucuccgccgacaaguccaucuccaccgccuaccuccaguggaccucccucaaggccuccgacaccgccaucuacuacugcgcccgccagcgcggcgacuacuacuacuucuacggcauggacgucuggggccagggcaccaccgucaccgucuccucc

SEQ ID NO: 15631 - RNA, 321 nt, Artificial Sequence
  derived and/or modified sequence opt2 from HuMab-005_LightChain_VJ-Region
gagaucguccucacccagucccccggcacccucucccucucccccggcgagcgcgccacccucuccugccgcgccucccaguccgucuccuccuccuaccucgccugguaccagcagaagcccggccaggucccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccucaccuucggcggcggcaccaaggucgagaucaag

SEQ ID NO: 15632 - RNA, 357 nt, Artificial Sequence
  derived and/or modified sequence opt2 from HuMab-006_HeavyChain_VDJ-Region
gagguccagcuccucgaguccggcggcggccucguccagcccggcggcucccuccgccucuccugcgccgccuccggcuucaccuucuccaacuacgcccucaucuggguccgccaggcccccggcaagggccucgagugggucuccaucauccgcggcggcgccggcuccaccuacuacgccgacuccgucaagggccgcuucaccaucucccgcgacaacuccaagaacacccucuaccuccagaugaacucccuccgcgccgaggacaccgccgucuacuacugcgccaaggcccgcaucuggggcccccucuucgacuacuggggccagggcacccucgucaccgucuccucc

SEQ ID NO: 15633 - RNA, 324 nt, Artificial Sequence
  derived and/or modified sequence opt2 from HuMab-006_LightChain_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccccccucaccuucggcggcggcaccaaggucgagaucaag

SEQ ID NO: 15634 - RNA, 360 nt, Artificial Sequence
  derived and/or modified sequence opt2 from HuMab-019_HeavyChain_VDJ-Region
cagguccagcuccagcaguggggcgccggccuccucaagcccuccgagacccucucccucaccugcgccgucuacggcggcuccuucuccgacuacuacuggaacuggauccgccagccccccggcaagggccucgaguggaucggcgagauccaccacgucggcuccaccaacuacaaccccucccucaagucccgcgucaccaucuccgucgacaccuccaagucccaguucucccucaagcucuccuccgucaccgccgccgacaccgccgucuacuacugcgcccgcggcuacuacgacuccggcgucuacuacuucgacuacugggcccagggcacccucgucaccgucuccucc

SEQ ID NO: 15635 - RNA, 360 nt, Artificial Sequence
  derived and/or modified sequence opt2 from HuMab-021_HeavyChain_VDJ-Region
cagguccagcuccagcaguggggcgccggccuccucaagcccuccgagacccucucccucaccugcgccgucuacggcggcuccuucuccgacuacuacuggaacuggauccgccagccccccggcaagggccucgaguggaucggcgagauccaccacuccggcuccaccaacuacaaccccucccucaagucccgcgucaccaucuccgucgacaccuccaagaaccaguucucccucaagcucuccuccgucaccgccgccgacaccgccgucuacuacugcgcccgcggcuacuacgccuccggcgucuacuacuucgacuacuggggccagggcacccucgucaccgucuccucc

SEQ ID NO: 15636 - RNA, 321 nt, Artificial Sequence
  derived and/or modified sequence opt2 from HuMab-021_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccaucaccuucggccagggcacccgccucgagaucaag

SEQ ID NO: 15637 - RNA, 360 nt, Artificial Sequence
  derived and/or modified sequence opt2 from HuMab-025_HeavyChain_VDJ-Region
cagguccagcuccagcaguggggcgccggccuccucaagcccuccgagacccucucccucaccugcgccgucuacggcggcuccuucuccgacuacuacuggaacuggauccgccagccccccggcaagggccucgaguggaucggcgagauccaccacuccggcuccaccaacuacaaccccucccucaagucccgcgucaccaucuccgucgacaccuccaagaaccaguucucccucaagcucuccuccgucaccgccgccgacaccgccgucuacuacugcgcccgcggcuacuacgacuccggcgucuacuacuucgacuacugggcccagggcacccucgucaccgucuccucc

SEQ ID NO: 15638 - RNA, 321 nt, Artificial Sequence
  derived and/or modified sequence opt2 from HuMab-025_LightChain_VJ-Region
gacauccagaugacccagucccccuccucccucuccgccuccgucggcgaccgcgucaccaucaccugccgcgccucccagggcaucucccgcuggcucgccugguaccagcagaagcccgagaaggcccccaagucccucaucuacgccgccuccucccuccgcuccggcguccccucccgcuucuccggcuccggcuccggcaccgacuucacccucaccaucuccucccuccagcccgaggacuucgccaccuacuacugccagcaguacaacuccuaccccaucaccuucggccagggcacccgccucgagaucaag

SEQ ID NO: 15639 - RNA, 360 nt, Artificial Sequence
  derived and/or modified sequence opt2 from HuMab-027_HeavyChain_VDJ-Region
cagguccagcuccagcaguggggcgccggccuccucaagcccuccgagacccucucccucaccugcgccgucuacggcggcuccuucuccgacuacuucuggaacuggauccgccagccccccggcaagggccucgaguggaucggcgagauccaccacuccggcuccaccaacuacaaccccucccucaagucccgcgucaccaucuccgucgacaccuccaagaaccaguucucccucaaccucuccuccgucaccgccgccgacaccgccgucuacuacugcgcccgcggccucaucggcuccggcuacuacuacuucgacuacugggaccagggcacccucgucaccgucuccucc

SEQ ID NO: 15640 - RNA, 360 nt, Artificial Sequence
  derived and/or modified sequence opt2 from HuMab-032_HeavyChain_VDJ-Region
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagaucaaccacuccggcgacaccaacuacaaccccucccucaccucccgcgucaccaucuccgucgacaccuccaagaaccaguucucccucaagcucuccuccgucaccgccgccgacaccgccgucuacuacugcgcccgccucuucuacggcuccggcaucuacuacuucgacuacuggggccagggcacccucgucaccgucuccucc

SEQ ID NO: 15641 - RNA, 321 nt, Artificial Sequence
  derived and/or modified sequence opt2 from HuMab-032_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccaccuuccgccuccaguccggcguccccucccgcuucuccggcuccggcuccggcaccgacuucacccucaccaucuccucccuccagcccgaggacuucgccaccuacuacugccagcaguacaacuccuucccccccaccuucggccagggcaccaaggucgagaucaag

SEQ ID NO: 15642 - RNA, 363 nt, Artificial Sequence
  derived and/or modified sequence opt2 from HuMab-033_HeavyChain_VDJ-Region
cagguccagcucgucgaguccggcggcggcgucguccagaccggccgcucccuccgccucuccugcgccgccuccggcuucaccuucuccucccacgccaugcacuggguccgccaggcccccggcaagggccucgagugggucgccgccaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcggcgacuacaucuccuccuccggcgucuucgacuacuggggccagggcacccucgucaccgucuccucc

SEQ ID NO: 15643 - RNA, 360 nt, Artificial Sequence
  derived and/or modified sequence opt2 from HuMab-035_HeavyChain_VDJ-Region
cagguccagcuccagcaguggggcgccggccuccucaagcccuccgagacccucucccucaccugcgccaucuacggcggcuccuucuccggcuacuacugguccuggauccgccagccccccggcaagggccucgaguggaucggcgagaucaaccacuccggcgacaccaacuacaaccccucccucaccucccgcgucaccaucuccgucgacaccuccaagaaccaguucucccucaagcucuccuccgucaccgccgccgacaccgccgucuacuacugcgcccgccucuucuacggcuccggcaucuacuacuucgacuacuggggccagggcacccucgucaccgucuccucc

SEQ ID NO: 15644 - RNA, 360 nt, Artificial Sequence
  derived and/or modified sequence opt2 from HuMab-036_HeavyChain_VDJ-Region
cagguccagcuccagcaguggggcgccggccuccucaagcccuccgagacccucucccucaccugcgccgucuacggcggcuccuucuccgacuacuacugguccuggauccgccagccccccggcaagggccucgaguggaucggcgagaucaaccacuccggcuccaccaacuacaaccccucccucaagucccgcgucaccaucuccgucgacaccuccaagaaccaguucucccucaagcucuccuccgucaccgccgccgacaccgccgucuacuacugcgcccgccucuacuacggcuccggcaccuacuacuucgacuacuggggccagggcacccucgucaccgucuccucc

SEQ ID NO: 15645 - RNA, 321 nt, Artificial Sequence
  derived and/or modified sequence opt2 from HuMab-036_LightChain_VJ-Region
gacauccagaugacccagucccccuccucccucuccgccuccgucggcgaccgcgucaccaucaccugccgcgccucccagggcaucuccuccuggcucaccugguaccagcagaagcccgagaaggcccccaagucccucaucuacgccgccucccgccuccaguccggcguccccucccgcuucuccggcuccggcuccggcaccgacuucacccucaccaucuccucccuccagcccgaggacuucgccaccuacuacugccagcaguacaacuccuucccccccaccuucggccagggcaccaaggucgagaucaag

SEQ ID NO: 15646 - RNA, 366 nt, Artificial Sequence
  derived and/or modified sequence opt2 from HuMab-041_HeavyChain_VDJ-Region
gagguccagcucguccaguccggcgccgaggucaagaagcccggcgagucccucaagaucuccugcaagggcuccggcuacuccuucaccuccuacuggaucggcuggguccgccagaugcccggcaagggccucgaguggaugggcuccaucuaccccggcgacucccacacccgcuaccgccccuccuuccagggccaggucaccaucuccgccgacaaguccaucuccaccgccuaccuccagugguccucccucaaggccuccgacaccgccauguacuacugcgcccgccagaagggcgacuucuacuacuucuucggccucgacgucuggggccagggcaccgccaucaccgucuccucc

SEQ ID NO: 15647 - RNA, 366 nt, Artificial Sequence
  derived and/or modified sequence opt2 from HuMab-044_HeavyChain_VDJ-Region
gagguccagcucguccaguccggcgccgaggucaagaagcccggcgagucccucaagaucuccugcaagggcuccggcuaccgcuucuccuccuacuggaucggcuggguccgccagaugcccggcaagggccucgaguggaugggcuccaucuuccccggcgacuccgacacccgcuacucccccuccuuccagggccaggucaccaucuccgccgacaaguccaucaccaccgccuaccuccagugguccucccucaaggccuccgacaccgccauguacuacugcgcccgccaggccggcgacuacuacuacuacaacggcauggacgucuggggccagggcaccaccgucaccgucuccucc

SEQ ID NO: 15648 - RNA, 357 nt, Artificial Sequence
  derived and/or modified sequence opt2 from HuMab-049_HeavyChain_VDJ-Region
gagguccagcuccucgaguccggcggcgaccucguccagcccggcggcucccuccgccucuccugcgccgccuccggcuucaccuucuccuccuacgccauguccuggguccgccaggcccccggcaagggccucgagugggucuccgccaucuccggccgcggcggcaccaccuacuacgccgacuccgucaagggccgcuucaccaucucccgcgacaacuccaaguccacccucugccuccagaugaacucccuccgcgccgaggacaccgccgucuacuacugcgccaaggcccgcgccaacugggacuacuucgacuacuggggccagggcacccucgucaccgucuccucc

SEQ ID NO: 15649 - RNA, 321 nt, Artificial Sequence
  derived and/or modified sequence opt2 from HuMab-049_LightChain_VJ-Region
gacauccagaugacccagucccccuccuccgucuccgccuccgucggcgaccgcgucaccaucaccugccgcgccucccagggcaucuccuccuggcucgccugguaccagcacaagcccggcaaggcccccaagcuccucaucuacgccgccuccauccuccaguccggcguccccucccgcuucuccggcuccggcuccggcaccgacuucacccucaccaucuccucccuccgccccgaggacuucgccaccuacuacugccagcaggccaacuccuuccccaucaccuucggccagggcacccgccucgagaucaag

SEQ ID NO: 15650 - RNA, 357 nt, Artificial Sequence
  derived and/or modified sequence opt2 from HuMab-050_HeavyChain_VDJ-Region
gagguccagcuccucgaguccggcggcggccucguccagcccggcggcucccuccgccucuccugcgccgccuccggcuucaccuucuccuccuacgccaugaacuggguccgccaggcccccggcaagggccucgagugggucuccgccaucuccggccgcggcggcaccaccuacuacgccgacuccgucaagggccgcuucaccaucucccgcgacaacuccaagaacacccucuaccuccagauguccucccuccgcgccgaggacaccgccgucuacuacugcgccaaggcccgcgccaacugggacuacuucgacuacuggggccagggcacccucgucaccgucuccucc

SEQ ID NO: 15651 - RNA, 321 nt, Artificial Sequence
  derived and/or modified sequence opt2 from HuMab-050_LightChain_VJ-Region
gacauccagaugacccagucccccuccuccgucuccgccuccgucggcgaccgcgucaccaucaccugccgcgccucccagggcaucuccuccuggcucgccugguaccagcacaagcccggcaaggcccccaagcuccucaucuacgccgccuccauccuccaguccggcguccccucccgcuucuccggcuccggcuccggcaccgacuucacccucaccaucuccucccuccagcccgaggacuucgccaccuacuacugccagcaggccaacuccuuccccaucaccuucggccagggcacccgccucgagaucaag

SEQ ID NO: 15652 - RNA, 360 nt, Artificial Sequence
  derived and/or modified sequence opt2 from HuMab-054_HeavyChain_VDJ-Region
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagauccaccacuccggcuccaccaacuacaaccccucccucaagucccgcgucaccaucuccgucgacaccuccaagaaccaguucucccucaagcucuccuccgucaccgccgccgacaccgccgucuacuacugcgcccgccucugguacggcuccggcuccuacuacuucgacuacuggggccagggcacccucgucaccgucuccucc

SEQ ID NO: 15653 - RNA, 321 nt, Artificial Sequence
  derived and/or modified sequence opt2 from HuMab-054_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuucccccccaccuucggcggcggcaccaaggucgagaucaag

SEQ ID NO: 15654 - RNA, 357 nt, Artificial Sequence
  derived and/or modified sequence opt2 from HuMab-055_HeavyChain_VDJ-Region
gagguccagcuccucgaguccggcggcggccucguccagcccggcggcucccuccgccucuccugcgccgccuccggcuucaccuucuccuccuacgccaugaacuggguccgccaggcccccggcaagggccucgagugggucuccgccaucuccggccgcggcggcaccaccuacuacgccgacuccgucaagggccgcuucaccaucucccgcgacaacuccaaguccacccucugccuccagaugaacucccuccgcgccgaggacaccgccgucuacuacugcgccaaggcccgcgccaacugggacuacuucgacuacuggggccagggcacccucgucaccgucuccucc

SEQ ID NO: 15655 - RNA, 366 nt, Artificial Sequence
  derived and/or modified sequence opt2 from HuMab-059_HeavyChain_VDJ-Region
cagguccagcucguccaguccggcgccgaggucaagaagcccggcgccuccguccgcguccccugcaaggccuccggcuacaccuucacccgcuacggcaucuccuggguccgccaggcccccggccagggccucgaguggaugggcuggaucuccgccuacaacggcaagaccuacuacgcccagaagcuccagggccgcgucaccaugaccaccgacaccuccaccuccaccgccuacauggagcuccgcucccuccgcuccgacgacaccgccgucuacuacugcgcccgcuccccccuccucugguucgaggagcucuacuucgacuacuggggccagggcacccucgucaccgucuccucc

SEQ ID NO: 15656 - RNA, 324 nt, Artificial Sequence
  derived and/or modified sequence opt2 from HuMab-059_LightChain_VJ-Region
gagaucguccucacccagucccccggcacccucucccucucccccggcgagcgcgccacccucuccugccgcgccucccaguccgucuccuccaccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcaccucccucuucaccuucggccccggcaccaaggucgacaucaag

SEQ ID NO: 15657 - RNA, 366 nt, Artificial Sequence
  derived and/or modified sequence opt2 from HuMab-060_HeavyChain_VDJ-Region
gagguccagcucguccaguccggcgccgaggucaagaagcccggcgagucccucaagaucuccugcaagggcuccggcuaccgcuucaccuccuacuggaucggcuggguccgccagaugcccggcaagggccucgaguggaugggcuccaucuaccccggcgacuccuacacccgcaacucccccuccuuccagggccaggucaccaucuccgccgacaaguccaucgccaccgccuaccuccaguggaacucccucaaggccuccgacaccgccauguacuacugcgcccgccacgccggcgacuucuacuacuucgacggccucgacgucuggggccagggcaccaccgucaccgucuccucc

SEQ ID NO: 15658 - RNA, 327 nt, Artificial Sequence
  derived and/or modified sequence opt2 from HuMab-060_LightChain_VJ-Region
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccccaucaccuucggccagggcacccgccucgagaucaag

SEQ ID NO: 15659 - RNA, 366 nt, Artificial Sequence
  derived and/or modified sequence opt2 from HuMab-067_HeavyChain_VDJ-Region
gagguccagcucguccaguccggcgccgaggucaagaagcccggcgagucccucaagaucuccugcaagggcuccggcuacuccuucaccuccuacuggaucggcuggguccgccagaugcccggcaagggccucgaguggaugggcaucaucuaccccggcgacuccgacacccgcuacucccccuccuuccagggccaggucaccaucuccgucgacaaguccaucuccaccgccuaccuccagugguccucccucaaggccuccgacaccgccauguacuacugcgcccgccagaagggcgacuacuacuaccacuacggccucgacgucuggggccagggcaccaccgucaccgucuccucc

SEQ ID NO: 15660 - RNA, 366 nt, Artificial Sequence
  derived and/or modified sequence opt2 from HuMab-072_HeavyChain_VDJ-Region
gagguccagcucguccaguccggcgccgaggucaagaagcccggcgagucccucaagaucuccugcaagggcuccggcuacuccuucaccuccuacuggaucggcuggguccgccagaugcccggcaagggccucgaguggaugggcaucaucuaccccggcgacuccgacacccgcuacucccccuccuuccagggccaggucaccaucuccgccgacaaguccaucuccaccgccuaccuccagugguccucccucaaggccuccgacaccgccauguacuacugcgcccgccagaagggcgacuacuacuacuucaacggccucgacgucuggggccagggcaccaccgucaccgucuccucc

SEQ ID NO: 15661 - RNA, 327 nt, Artificial Sequence
  derived and/or modified sequence opt2 from HuMab-072_LightChain_VJ-Region
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccgccucaccuucggcggcggcaccaaggucgagaucaag

SEQ ID NO: 15662 - RNA, 363 nt, Artificial Sequence
  derived and/or modified sequence opt2 from HuMab-084_HeavyChain_VDJ-Region
cagguccagcucguccaguccggcgccgaggucaagaagcccggcuccuccgucaaggucuccugcaaggccuccggcggcaccuuccgcaccuacgccaucaacuggguccgccaggcccccggccagggccucgaguggaugggccgcaucaacaccguccucggcaucgucaaccacgcccagaaguuccagggccgcgucaccaucaccgccgacaaguccaccaacaccgccuacauggagcucaacucccuccgcuccgaggacaccgccgucuacuacugcgcccgcgagaagggcgucgacuacuacuacggcaucgaggucuggggccagggcaccaccgucaccgucuccucc

SEQ ID NO: 15663 - RNA, 321 nt, Artificial Sequence
  derived and/or modified sequence opt2 from HuMab-084_LightChain_VJ-Region
gacauccagaugacccagucccccuccuccgucuccgccuccgucggcgaccgcgucaccaucaccugccgcgccucccagggcaucuccuccuggcucgccugguaccagcacaagcccggcaaggcccccaagcuccucaucuacgucgccuccacccuccaguccggcguccccucccgcuucuccggcuccggcuccggcaccgacuucacccucaccaucuccucccuccagcccgaggacuucgccaccuacuacugccagcaggccaacuccuucccccucaccuucggcggcggcaccaaggucgagaucaag

SEQ ID NO: 15664 - RNA, 360 nt, Artificial Sequence
  derived and/or modified sequence opt2 from HuMab-091_HeavyChain_VDJ-Region
cagguccagcuccagcaguggggcgccggccuccucaagcccuccgagacccucucccucaccugcgccgucuccggcggcuccuucuccggcuacuacuggaccuggauccgccagccccccggcaagggccucgaguggaucggcgagaucuaccacuccggcgacaccaacuacaaccccucccucaagucccgcgucaccaucuccgucgacaccuccaagaaccaguucucccucaagcucuacuccgucaccgccgccgacaccgccgucuacuacugcgcccgccucuacuucggcuccggcaucuacuaccucgacuacuggggccagggcacccucgucaccgucuccucc

SEQ ID NO: 15665 - RNA, 321 nt, Artificial Sequence
  derived and/or modified sequence opt2 from HuMab-091_LightChain_VJ-Region
gacauccagaugacccagucccccuccucccucuccgccuccgucggcgaccgcgucaccaucaccugccgcgccucccagggcaucuccuccuggcucgucugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuucccccccaccuucggccagggcaccaaggucgagaucaag

SEQ ID NO: 15666 - RNA, 366 nt, Artificial Sequence
  derived and/or modified sequence opt2 from HuMab-093_HeavyChain_VDJ-Region
gagguccagcucguccaguccggcgccgaggucaagaagcccggcgagucccucaagaucuccugcaagggcuccggcuacuccuucaccuccuacuggaucggcuggguccgccagaugcccggcaagggccucgaguggaugggccgcaucuaccccggcgacuccgacacccgcuacucccccuccuuccagggccaggucaccaucuccgccgacaaguccaucaccaccgccuaccuccagugguccucccuccgcgccuccgacaccgccauguacuacugcgcccgccagcgcggcgacuacuacuacuucuucggccucgacaucuggggccagggcaccaccgucaccgucucccuc

SEQ ID NO: 15667 - RNA, 372 nt, Artificial Sequence
  derived and/or modified sequence opt2 from HuMab-098_HeavyChain_VDJ-Region
gagguccagcuccucgaguccggcggcggccucguccagcccggcggcucccuccgccucuccugcgccgccuccggcuucaccuucuccaacuacggcauguccuggguccgccaggcccccggcaagggccucgagugggucuccgccaucuccggcuccgccuacuccaccuacuacgccgacuccgucaagggccgcuucaccaucucccgcgacaacuccaagaacacccucuggcuccagaugaacucccuccgcgccgaggacaccgccgucuacuacugcgccaaggcccacuaccacggcuccggcuccuacuacacccucuucgacuacuggggccagggcacccucgucaccgucuccucc

SEQ ID NO: 15668 - RNA, 321 nt, Artificial Sequence
  derived and/or modified sequence opt2 from HuMab-098_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuacaccuucggccagggcaccaagcucgagaucaag

SEQ ID NO: 15669 - RNA, 372 nt, Artificial Sequence
  derived and/or modified sequence opt2 from HuMab-100_HeavyChain_VDJ-Region
gagguccagcuccucgaguccggcggcggccucguccagcccggcggcucccuccgccucuccugcgccgccuccggcuucaccuucaacaacuacggcaugaacuggguccgccaggcccccggcaagggccucgagugggucuccgccaucuccggcaccggcuacuccaccuacuacgccgacuccgucaagggccgcuucaccaucucccgcgacaacuccaagaacacccucuaccuccagaugaacucccuccgcgccgaggacaccgccgucuacuacugcgccaaggcccacuacuucggcuccggcuccuacuacacccucuucgacuacuggggccagggcacccucgucaccgucuccucc

SEQ ID NO: 15670 - RNA, 372 nt, Artificial Sequence
  derived and/or modified sequence opt2 from HuMab-106_HeavyChain_VDJ-Region
gagguccagcucguccaguccggcgccgaggucaagaagcccggcgagucccucaagaucuccugcaagggcuccggcuacuccuucacccgcuacuggaucggcuggguccgccagaugcccggcaagggccucgaguggaugggcaucaucuaccccggcgacuccgacacccgcuacucccccuccuuccagggccaggucaccaucuccgccgacaaguccaucuccaccgccuaccuccagugguccucccucaaggccuccgacaccgccauguacuacugcgcccgccucaccggcgaccgcggcuucgacuacuacuccggcauggacgucuggggccagggcaccaccgucaccgucuccucc

SEQ ID NO: 15671 - RNA, 321 nt, Artificial Sequence
  derived and/or modified sequence opt2 from HuMab-106_LightChain_VJ-Region
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccuucaccuucggccccggcaccaaggucgacaucaag

SEQ ID NO: 15672 - RNA, 351 nt, Artificial Sequence
  derived and/or modified sequence opt2 from HuMab_10F8_HeavyChain_V-Region
cagguccagcucgucgaguccggcggcggcgucguccagcccggccgcucccuccgccucuccugcaccgccuccggcuucaccuucucccacuacggcauguacuggguccgccaggcccccggcaagggccucgagugggucgccgucaucugguacgacggcuccuacgaguacaacgaggacuccgucaagggccgcuucaccaucucccgcgacaacuccaagaacacccucuaccuccagaugaacucccuccgcgccgaggacaccgccgucuacuacugcgcccgcgaccgcgucggccucuucgacuacuggggccagggcacccucgucaccgucuccucc

SEQ ID NO: 15673 - RNA, 408 nt, Artificial Sequence
  derived and/or modified sequence opt2 from HuMab_10F8_HeavyChain_V-Region_Precursor
auggaguucggccucuccugggucuuccucgucgcccuccuccgcggcguccagugccagguccagcucgucgaguccggcggcggcgucguccagcccggccgcucccuccgccucuccugcaccgccuccggcuucaccuucucccacuacggcauguacuggguccgccaggcccccggcaagggccucgagugggucgccgucaucugguacgacggcuccuacgaguacaacgccgacuccgucaagggccgcuucaccaucucccgcgacaacuccaagaacacccucuaccuccagaugaacucccuccgcgccgaggacaccgccgucuacuacugcgcccgcgaccgcgucggccucuucgacuacuggggccagggcacccucgucaccgucuccucc

SEQ ID NO: 15674 - RNA, 321 nt, Artificial Sequence
  derived and/or modified sequence opt2 from HuMab_10F8_LightChain_V-Region
gagaucguccucacccagucccccggcacccucucccucucccccggcgagcgcgccacccucuccugccgcgccucccaguccaucuccuccuccuaccucgccugguaccagcagaagcccggccaggccccccgccuccucaucuacggccccuccucccgcgccaccggcauccccgaccgcuucuccggcuccggcuccggcaccgacuucacccucaccaucucccgccucgagcccgaggacuucgccgucuacuacugccagcaguacgccggcucccucaccuucggccccggcaccaaggucgacaucaag

SEQ ID NO: 15675 - RNA, 381 nt, Artificial Sequence
  derived and/or modified sequence opt2 from HuMab_10F8_LightChain_V-Region_Precursor
auggagacccccgcccagcuccucuuccuccuccuccucuggcuccccgacaccaccggcgagaucguccucacccagucccccggcacccucucccucucccccggcgagcgcgccacccucuccugccgcgccucccaguccaucuccuccuccuaccucgccugguaccagcagaagcccggccaggccccccgccuccucaucuacggccccuccucccgcgccaccggcauccccgaccgcuucuccggcuccggcuccggcaccgacuucacccucaccaucucccgccucgagcccgaggacuucgccgucuacuacugccagcaguacgccggcucccucaccuucggccccggcaccaaggucgacaucaag

SEQ ID NO: 15676 - RNA, 357 nt, Artificial Sequence
  derived and/or modified sequence opt2 from HuMab-111_HeavyChain_VDJ-Region
cagguccagcucguccaguccggcgccgaggucaagaagcccggcuccuccgucaaggucuccugcaaggccuccggcggcaccuucuccuccuacggcaucuccuggguccgccaggcccccggccccggccucgaguggaugggccgcaucauccccauccucggcaucgccaacuacgcccagaaguuccagggccgcgucaccaucaccgccgacaaguccaccaacaccgccuacauggagcucuccucccuccgcuccgaggacaccgccgucuacuacugcgcccgcgaccaggaguacuccuccaacugguacuacuggggccagggcacccucgucaccgucuccucc

SEQ ID NO: 15677 - RNA, 321 nt, Artificial Sequence
  derived and/or modified sequence opt2 from HuMab-111_LightChain_VJ-Region
gagaucguccucacccagucccccggcacccucucccucucccccggcgagcgcgccacccucuccugccgcgccucccaguccguccgcuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcucuacggcuccucccccaccuucggccccggcaccaaggucgacaucaag

SEQ ID NO: 15678 - RNA, 363 nt, Artificial Sequence
  derived and/or modified sequence opt2 from HuMab-123_HeavyChain_VDJ-Region
cagguccagcucguccaguccggcgccgaggucaagaagcccggcgccuccgucaaggucuccugcaaggccgccggcuacaccuucaccaacuacggcaucuccuggguccgccaggcccccggccaggcccucgaguggaugggcuggaucaccaccuacuccuccaacaccaucuacgcccagaagcuccagggccgcgucaccaugaccaccgacaccuccaccuccaccgccuacauggagcuccgcucccuccgcuccgacgacaccgccgucuacuacugcgcccgcgaccgcgucgucguccgccccgacuacuucgacuacuggggccagggcacccucgucaccgucuccucc

SEQ ID NO: 15679 - RNA, 321 nt, Artificial Sequence
  derived and/or modified sequence opt2 from HuMab-123_LightChain_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacaccuccaaccgcgccaccggcauccccgcccgcuucuccggcuccggcuccggcaccgacuucacccucaccaucuccucccucgagcccgaggacuucgccgucuacuacugccagcagcgcucccacuggccccgcaccuucggccagggcaccaaggucgagaucaag

SEQ ID NO: 15680 - RNA, 363 nt, Artificial Sequence
  derived and/or modified sequence opt2 from HuMab-124_HeavyChain_VDJ-Region
cagguccagcucguccaguccggcgccgaggucaagaagcccggcgccuccgucaaggucuccugcaaggccgccggcuacaccuucaccaacuacggcaucuccuggguccgccaggcccccggccagggccucgaguggaugggcuggaucaucaccuacaacggcaacaccaucuacgcccagcgcuuccaggaccgcgucaccaugaccaccgacaccuccaccuccaccgccuacauggagcuccgcucccuccgcuccgacgacaccgccgucuacuacugcgcccgcgaccgcaucaucguccgccccgacuacuucgacuacuggggccagggcacccucgucaccgucuccucc

SEQ ID NO: 15681 - RNA, 372 nt, Artificial Sequence
  derived and/or modified sequence opt2 from HuMab-125_HeavyChain_VDJ-Region
gagguccagcuccucgaguccggcggcggccucguccagcccggcggcucccuccgccucuccugcgccgccuccggcuucaccuucaccgacuacgccaugaacuggguccgccaggcccccggcaagggccucgagugggucuccaccaucuccggcuccggcuacgccaccuacuacgccgacuccgucaagggccgcuucaccaucucccgcgacaacuccaagaccacccucuaccuccagaugaacucccuccgcgccgaggacaccgccgucuacuacugcgccaagggccacacccucggcuccggcuccuacuacacccucuucgacuacuggggccagggcacccucgucaccgucuccucc

SEQ ID NO: 15682 - RNA, 321 nt, Artificial Sequence
  derived and/or modified sequence opt2 from HuMab-125_LightChain_VJ-Region
gacauccagaugacccagucccccuccucccucuccgccuccgucggcgaccgcgucaccaucaccugccgcgccucccagggcaucaacuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuacaccuucggccagggcaccaagcucgagaucaag

SEQ ID NO: 15683 - RNA, 369 nt, Artificial Sequence
  derived and/or modified sequence opt2 from HuMab-127_HeavyChain_VDJ-Region
gagguccagcucguccaguccggcgccgaggucaagaagcccggcgagucccucaccaucuccugcaagggcuccggcuacuccuucuccaucuacuggaucggcuggguccgccagaugcccggcaagggccucgaguggaugggcaucaucuuccccggcgacuccgacauccgcuacucccccuccuuccagggccaggucaccaucuccgccgacaaguccaucuccaccgccuaccuccagugguccucccucaaggccuccgacaccgccauguacuacugcgcccgccagcccggcgacugguccccccgccacugguacuucgaccucuggggccgcggcacccucgucaccgucuccucc

SEQ ID NO: 15684 - RNA, 321 nt, Artificial Sequence
  derived and/or modified sequence opt2 from HuMab-127_LightChain_VJ-Region
gucaucuggaugacccagucccccucccuccucuccgccuccaccggcgaccgcgucaccaucuccugccgcaugucccagggcaucuccuccuaccucgccugguaccagcagaagcccggcaaggcccccgagcuccucaucuacgccgccuccacccuccaguccggcguccccucccgcuucuccggcuccggcuccggcaccgacuucacccucaccaucuccuaccuccaguccgaggacuucgccaccuacuacugccagcaguacuacuccuucccccucaccuucggcggcggcaccaaggucgagaucaag

SEQ ID NO: 15685 - RNA, 357 nt, Artificial Sequence
  derived and/or modified sequence opt2 from HuMab-129_HeavyChain_VDJ-Region
cagguccagcucgucgaguccggcggcggcgucguccagcccggccgcucccuccgccucuccugcgccgccuccggcuucaccuucuccaccuucgccauccacuggguccgccaggcccccggcaagggccucgagugggucgccgucaucuccuacgacggcggccacaaguucuacgccgacuccgucaagggccgcuucaccaucucccgcgacaacuccaagaacacccucuaccuccagaugaacucccuccgcgccgaggacaccgccauguacuacugcgcccgcggccucggcgucuggggcgccuucgacuacuggggccagggcacccucgucaccgucuccucc

SEQ ID NO: 15686 - RNA, 318 nt, Artificial Sequence
  derived and/or modified sequence opt2 from HuMab-129_LightChain_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacugguggaccuucggccagggcaccaaggucgagaucaag

SEQ ID NO: 15687 - RNA, 375 nt, Artificial Sequence
  derived and/or modified sequence opt2 from HuMab-132_HeavyChain_VDJ-Region
cagguccagcucguccaguccggcgccgaggucaagaagcccggcgccuccgucaaggucuccugcaaggccuccggcuacaccuucaccuccuacggcaucuccuggguccgccaggcccccggccagggccucgaguggaugggcuggaucuccgccuacaacggcaacuccaacuacguccagaaguuccagggccgcgucaccaugaccaccgacaccaccaccuccaccgccuacauggagcuccgcucccucaccuccgacgacaccgccgucuacuacugcgcccgcgaguacuccuacgacuccggcaccuacuucuacuacggcauggacgucuggggccagggcaccaccgucaccgucuccucc

SEQ ID NO: 15688 - RNA, 324 nt, Artificial Sequence
  derived and/or modified sequence opt2 from HuMab-132_LightChain_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccauguacaccuucggccagggcaccaagcucgagaucaag

SEQ ID NO: 15689 - RNA, 360 nt, Artificial Sequence
  derived and/or modified sequence opt2 from HuMab-143_HeavyChain_VDJ-Region
cagguccagcuccagcaguggggcgccggccuccucaagcccuccgagacccucucccucaccugcgccgucuacggcggcuccuucuccggcuacuacuggaacuggauccgccagccccccggcaagggccucgaguggaucggcgagauccaccacuccggcuccgccaacuacaaccccucccucaugucccgcgucaccaucuccgucgacaccuccaagaaccaguucucccuccagcucuccuccgucaccgccgccgacaccgccgucuacuacugcgcccgcggcuacuacggcuccggcuacuacuacuucgacuacuggggccagggcacccucgucaccgucuccucc

SEQ ID NO: 15690 - RNA, 321 nt, Artificial Sequence
  derived and/or modified sequence opt2 from HuMab-143_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccucccgccuccaguccggcguccccucccgcuucuccggcuccggcuccggcaccgacuucacccucaccaucuccucccuccagcccgaggacuucgccaccuacuacugccagcaguacaacuccuaccccaucaccuucggccagggcacccgccucgagaucaag

SEQ ID NO: 15691 - RNA, 366 nt, Artificial Sequence
  derived and/or modified sequence opt2 from HuMab-150_HeavyChain_VDJ-Region
gagguccagcucguccaguccggcgccgaggucaagaagcccggcgagucccucaagaucuccugcaagggcuccggcuacuccuucaccuccuacuggaucggcuggguccgccagaugcccggcaagggccucgaguggaugggcuccaucuaccccggcgacucccacacccgcuaccgccccuccuuccagggccaggucaccaucuccgccgacaaguccaucuccaccgccuaccuccagugguccucccucaaggccuccgacaccgccauguacuacugcgcccgccaggccggcgacuacuacuacuacaacggcauggacgucuggggccagggcaccaccgucaccgucuccucc

SEQ ID NO: 15692 - RNA, 321 nt, Artificial Sequence
  derived and/or modified sequence opt2 from HuMab-150_LightChain_VJ-Region
gagaucguccucacccagucccccggcacccucucccucucccccggcgagcgcgccacccucuccugccgcgccucccaguccgucuccuccuccuaccucaccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccucaccuucggcggcggcaccaaggucgagaucaag

SEQ ID NO: 15693 - RNA, 363 nt, Artificial Sequence
  derived and/or modified sequence opt2 from HuMab-152_HeavyChain_VDJ-Region
cagguccaggucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccuacaaguacuacgccgacuccgucaagggccgcuucaccaucucccgcgacaacuccaagaacacccucuaccuccagaugaacucccuccgcgccgaggacaccgccgucuacuacugcgcccgcggcuccaucaccggcuccaccggcgucuucgacuacuggggccagggcacccucgucaccgucuccucc

SEQ ID NO: 15694 - RNA, 321 nt, Artificial Sequence
  derived and/or modified sequence opt2 from HuMab-152_LightChain_VJ-Region
gacauccagaugacccagucccccuccucccucuccgccuccgucggcgaccgcgucaccaucaccugccgcgccucccagggcaucaacuccuggcucgccugguaccagcagaagcccgagaaggcccccaagucccucaucuacgacgccuccucccuccaguccggcguccccucccgcuucuccggcuccggcuccggcaccgacuucacccucaccaucuccucccuccagcccgagaacuucgccaccuacuacugccagcaguacaacuccuaccccaucaccuucggccagggcacccgccucgagaucaag

SEQ ID NO: 15695 - RNA, 363 nt, Artificial Sequence
  derived and/or modified sequence opt2 from HuMab-153_HeavyChain_VDJ-Region
cagguccagcucgucgaguccggcggcggcgucguccagcccggccgcucccuccgccucuccugcgccgccuccggcuucaccuucuccgacuacgucauccacuggguccgccaggcccccggcaagggccucgagugggucaccgucaucuccuacgacggcuccaacaaguacuacgccgacuccgucaagggccgcuucaccaucucccgcgacaacuccaagaacacccucuaccuccagaugaacucccucuccgccgaggacaccgccauguacuacugcgcccgcggcggcaucaccggcaccaccggcgucuucgacuacuggggccagggcacccucgucaccgucuccucc

SEQ ID NO: 15696 - RNA, 321 nt, Artificial Sequence
  derived and/or modified sequence opt2 from HuMab-153_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgacgccuccucccuccaguccggcguccccucccgcuucuccggcuccggcuacggcaccgacuucucccucaccaucuccucccuccagcccgaggacuucgccaucuacuacugccagcaguacaaguccuaccccaucaccuucggccagggcacccgccucgagaucaag

SEQ ID NO: 15697 - RNA, 378 nt, Artificial Sequence
  derived and/or modified sequence opt2 from HuMab-159_HeavyChain_VDJ-Region
gagguccagcucguccaguccggcgccgaggucaagaagcccggcgagucccucaagaucuccugcaagggcuccggcuacaacuucaccuccuacuggaucggcuggguccgccagaugcccggcaagggccucgaguggaugggcaucaucuaccccggcgacuccgacacccgcuacucccccuccuuccagggccaggucaccaucuccgccgacaaguccaucuccaccgccuaccuccagugguccucccucaaggccuccgacaccgccauguacuacugcgcccgcuggggcaccuacuacgacauccucaccggcuacuucaacugguucgaccccuggggccagggcacccucgucaccgucuccucc

SEQ ID NO: 15698 - RNA, 321 nt, Artificial Sequence
  derived and/or modified sequence opt2 from HuMab-159_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacuacaucuaccccuggaccuucggccagggcaccaaggucgagaucaag

SEQ ID NO: 15699 - RNA, 363 nt, Artificial Sequence
  derived and/or modified sequence opt2 from HuMab-160_HeavyChain_VDJ-Region
cagguccagcucgucgaguccggcggcggcgucguccagcccggccgcucccuccgccucuccugcgccgccuccggcuucaccuucuccucccacgccaugcacuggguccgccaggcccccggcaagggccucgagugggucgccgccaucuccuacgacggcuccaacaaguacuacgccgacuccgucaagggccgcuucaccaucucccgcgacaacuccaagaacaccauguaccuccagaugaacucccuccgcgccgaggacaccgccaugugcuacugcgcccgcggcuccaucaccggcuccaccggcgucuucgacuacuggggccagggcacccucgucaccgucuccucc

SEQ ID NO: 15700 - RNA, 321 nt, Artificial Sequence
  derived and/or modified sequence opt2 from HuMab-160_LightChain_VJ-Region
gacauccagaugacccagucccccuccucccucuccgccuccgucggcgaccgcgucaccaucaccugccgcgccucccaggacaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccaucaccuucggccagggcacccgccucgagaucaag

SEQ ID NO: 15701 - RNA, 372 nt, Artificial Sequence
  derived and/or modified sequence opt2 from HuMab-162_HeavyChain_VDJ-Region
gagguccagcucugggaguccggcggcggcuccguccagcccggcggcucccuccgccucuccugcgccgccuccggcuucaccuucuccuccuacggcauguccuggguccgccaggcccccggcaagggccucgagugggucuccggcaucuccggcuccggcuacuccaccuacuacgccgacuccgucaagggccgcuucaccaucucccgcgacaacuccaagaacacccucuaccuccagaugaacucccuccgcgccgaggacaccgccgucuacuacugcgccaagggcuacuaccacggcuccggcuccuacuacaccuccuucgacuacuggggccagggcacccucgucaccgucuccucc

SEQ ID NO: 15702 - RNA, 321 nt, Artificial Sequence
  derived and/or modified sequence opt2 from HuMab-162_LightChain_VJ-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuacccccucaccuucggcggcggcaccaaggucgagaucaag

SEQ ID NO: 15703 - RNA, 366 nt, Artificial Sequence
  derived and/or modified sequence opt2 from HuMab-163_HeavyChain_VDJ-Region
gagguccagcucguccaguccggcgccgaggucaagaagcccggcgagucccucaagaucuccugccagggcuccggcuaccgcuucaucuccuacuggaucggcuggguccgccagaugcccggcaagggccucgaguggaugggccgcaucuaccccggcgacuccgacacccgcuacucccccuccuuccagggccaggucaccaucuccgucgacaaguccaucuccaccgccuaccuccagugguccucccucaaggccuccgacaccgccauguacuacugcgcccgccagcgcggcgacuacuacuacuucaacggccucgacgucuggggccagggcaccaccgucaccgucuccucc

SEQ ID NO: 15704 - RNA, 321 nt, Artificial Sequence
  derived and/or modified sequence opt2 from HuMab-163_LightChain_VJ-Region
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccucaccuucggcggcggcaccaaggucgagaucaag

SEQ ID NO: 15705 - RNA, 363 nt, Artificial Sequence
  derived and/or modified sequence opt2 from HuMab-166_HeavyChain_VDJ-Region
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacgaguacuacgccgacuccgucaagggccgcuucaccaucucccgcgacaacuccaagaacacccucuaccuccagaugaacucccuccgcgccgaggacaccgccgucuacuacugcgcccgcggcuccaucaucggcuccaccggcgucuucgacuacuggggccagggcacccucgucaccgucuccucc

SEQ ID NO: 15706 - RNA, 321 nt, Artificial Sequence
  derived and/or modified sequence opt2 from HuMab-166_LightChain_VJ-Region
gacauccagaugacccagucccccuccucccucuccgccuccgucggcgaccgcgucaccaucaccugccgcgccucccagggcaucuccaacuggcucgccugguaccagcagaagcccgagaaggcccccaagucccucaucuacgacgccuccucccuccaguccggcguccccucccgcuucuccggcuccggcuccggcaccgacuucacccucaccaucuccucccuccagcccgaggacuucgccaccuacuacugccagcaguacaacuccuaccccaucaccuucggccagggcacccgccucgagaucaag

SEQ ID NO: 15707 - RNA, 363 nt, Artificial Sequence
  derived and/or modified sequence opt2 from HuMab-167_HeavyChain_VDJ-Region
cagguccagcucgucgaguccggcggcggcgucguccagcccggccgcucccuccgccucuccugcgccgccuccggcuucaccuucuccuccuacgccauccacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcggcuccaucaccggcuccaccggcgucuucgacuacuggggccagggcacccucgucaccgucuccucc

SEQ ID NO: 15708 - RNA, 363 nt, Artificial Sequence
  derived and/or modified sequence opt2 from HuMab-169_HeavyChain_VDJ-Region
cagguccagcucguccaguccggcgccgaggucaagaagcccggcgccuccgucaaggucuccugcaaggccuccggcuacaccuucaccaacuacggcaucuccuggguccgccaggcccccggccagggccucgaguggaugggcuggcucuccgccuacuccggcaacaccaucuacgcccagaagcuccagggccgcgucaccaugaccaccgacaccuccaccaccaccgccuacauggagcuccgcucccuccgcuccgacgacaccgccgucuacuacugcgcccgcgaccgcaucgucguccgccccgacuacuucgacuacuggggccagggcacccucgucaccgucuccucc

SEQ ID NO: 15709 - RNA, 321 nt, Artificial Sequence
  derived and/or modified sequence opt2 from HuMab-169_LightChain_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccgcaccuucggccagggcaccaaggucgagaucaag

SEQ ID NO: 15710 - RNA, 366 nt, Artificial Sequence
  derived and/or modified sequence opt2 from HuMab-7D8_HeavyChain_VH-Region
gagguccagcucgucgaguccggcggcggccucguccagcccgaccgcucccuccgccucuccugcgccgccuccggcuucaccuuccacgacuacgccaugcacuggguccgccaggcccccggcaagggccucgagugggucuccaccaucuccuggaacuccggcaccaucggcuacgccgacuccgucaagggccgcuucaccaucucccgcgacaacgccaagaacucccucuaccuccagaugaacucccuccgcgccgaggacaccgcccucuacuacugcgccaaggacauccaguacggcaacuacuacuacggcauggacgucuggggccagggcaccaccgucaccgucuccucc

SEQ ID NO: 15711 - RNA, 366 nt, Artificial Sequence; identical to SEQ ID NO: 15710
  derived and/or modified sequence opt2 from HuMab-7D8_HeavyChain_V-Region

SEQ ID NO: 15712 - RNA, 321 nt, Artificial Sequence
  derived and/or modified sequence opt2 from HuMab-7D8_LightChain_VL-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaucaccuucggccagggcacccgccucgagaucaag

SEQ ID NO: 15713 - RNA, 321 nt, Artificial Sequence; identical to SEQ ID NO: 15712
  derived and/or modified sequence opt2 from HuMab-7D8_LightChain_V-Region

SEQ ID NO: 15714 - RNA, 324 nt, Artificial Sequence
  derived and/or modified sequence opt2 from huMAb-anti-MSP10.1_LightChain_VJ-Region
gagaucguccucacccagucccccgacauccucucccucucccccggcgagcgcgccacccucuccugccgcgccucccaggcccucaccgccaaguaccucgccugguaccagcagaagcccggccaggucccccgccuccucaucuacggcuccuccacccgcgccaccggcauccccgaccgcuuccgcggcuccggcuccggcaccgacuucacccucaccaucucccgccucgagcccgccgacuccgccgucuacuacugccagcaguacgaggacucccccuggaccuucggccagggcaccaagcucgagaucaag

SEQ ID NO: 15715 - RNA, 324 nt, Artificial Sequence
  derived and/or modified sequence opt2 from huMAb-anti-MSP10.2_LightChain_VJ-Region
gagaucguccucacccagucccccgacacccucucccucucccccggcgagaccgccacccucuccugccgcgccucccagaccguccgccgcaacucccucgccugguaccagcagaagcccggccaggccccccgccuccucaucuacggcgccuccgaccgcgccaccggcauccccgaccgcuucuccggcuccggcuucggcaccgacuucacccucaccgucuccggccucgagcccgaggacuucgccgucuacuacugccagcaguacggcaccuccccccgcaccuucggccagggcaccaagcucgagaucaag

SEQ ID NO: 15716 - RNA, 324 nt, Artificial Sequence
  derived and/or modified sequence opt2 from HUMAB-Clone_18_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaagcgcgccaccggcauccccgcccgcuucuccggcuccggcuccggcaccgacuucacccucaccaucuccucccucgagcccgaggacuucgccgucuacuacugccagcagcgcuccaaguggccccccuggaccuucggccagggcaccaaggucgaguccaag

SEQ ID NO: 15717 - RNA, 324 nt, Artificial Sequence
  derived and/or modified sequence opt2 from HUMAB-Clone_22_VJ-Region
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaaguggccccccuggaccuucggccagggcaccaaggucgagaucaag

SEQ ID NO: 15718 - RNA, 432 nt, Artificial Sequence
  derived and/or modified sequence opt2 from HuMab-L612_Chain_VDJ-Region_Precursor
auggaguucggccucaccuggcucuuccucgucgccaaccucaagggcguccagugcgagguccagcuccucgacuccggcggcggccucguccagcccggcggcugccuccgccucuccugcgccgccuccggcuucaccuucuccuccugcgccauguccuggguccgccaggcccccggcaagggccucgagugggucuccgccaucuccggcuccggcggcuccaccuacuacgccgacuccgucaagggccgcuucaccaucucccgcgacaaguccaagaacacccucuaccuccagaugaacucccuccgcgccgaggacaccgccgucuacuacugcgccaagggcggcaacgacauccucaccggcuacuacgccuggggccagggcacccucgucaccgucuccuccggcuccgccuccgcc

SEQ ID NO: 15719 - RNA, 321 nt, Artificial Sequence
  derived and/or modified sequence opt2 from HuMab_LC5002-002_LightChain_V-Region
gacauccagaugacccagucccccuccucccucuccgccuccgucggcgaccgcgucaccaucaccugccgcgccucccagggcaucucccgcugggucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuggaccuucggccagggcaccaaggucgagaucaag

SEQ ID NO: 15720 - RNA, 357 nt, Artificial Sequence
  derived and/or modified sequence opt2 from HuMab_LC5002-002_gamma1-Chain_V-Region
gagguccagcuccucgaguccggcggcggccucguccagcccggcggcucccuccgccucuccugcgccgccuccggcuucaccuucaacaucuacgccaugaacuggguccgccaggcccccggcaagggccucgagugggucuccgucaucuccggccgcggcaucaccaccuacuacgccgacuccgucaagggccgcuucaccaucucccgcgacaacuccaagaacacccucuaccuccagaugaacucccuccgcgccgacgacaccgccgucuacuacugcgccaagggcuccuccuccuggaccgacuucgacuacuggggccagggcacccucgucaccgucuccucc

SEQ ID NO: 15721 - RNA, 321 nt, Artificial Sequence
  derived and/or modified sequence opt2 from HuMab_LC5002-003_LightChain_V-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuggaccuucggccagggcaccaaggucgagaucaag

SEQ ID NO: 15722 - RNA, 357 nt, Artificial Sequence
  derived and/or modified sequence opt2 from HuMab_LC5002-003_gamma1-Chain_V-Region
gagguccagcuccucgaguccggcggcgaccucauccagcccggcggcucccuccgccucuccugcgccgccuccggcuucaccuucaacaucuacgccaugaacuggguccgccaggcccccggcaagggccucgagugggucuccgucaucuccggccgcggcaucaccaccuacuacgccgacuccgucaagggccgcuucaccaucucccgcgacaacuccaagaacacccucuaccuccagauggacucccuccgcgccgaggacaccgccgucuacuacugcgccaagggcuccuccuacuggaccgacuucgacuacuggggccagggcacccucgucaccgucuccucc

SEQ ID NO: 15723 - RNA, 321 nt, Artificial Sequence
  derived and/or modified sequence opt2 from HuMab_LC5002-005_LightChain_V-Region
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacucccacccccccaccuucggccagggcaccaagcucgagaucaag

SEQ ID NO: 15724 - RNA, 354 nt, Artificial Sequence
  derived and/or modified sequence opt2 from HuMab_LC5002-005_gamma1-Chain_V-Region
gagguccagguccucgacuccggcggcggccucguccagcccggcggcucccuccgccucuccugcaccgccuccggcuucaccuuccgccucuacaccauguccuggguccgccagacccccggccgcggccucgagugggucuccggcaucuccggcuccggccucuccaccuacuucgccgacuccgucaagggccgcuucaccaucucccgcgacaacuccaagaacaccgucuaccuccagaugaacucccuccgcgccgaggacaccgccgucuacuacugcgccaaggagggcgacuggaucuacuucgacuccuggggccagggcacccucgucaucgucuccucc

SEQ ID NO: 15725 - RNA, 321 nt, Artificial Sequence
  derived and/or modified sequence opt2 from HuMab_LC5002-007_LightChain_V-Region
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaucggcauccccgaccgcuucuccggcuccggcuccggcaccgacuucacccucaccaucucccgccucgagcccgaggacuucgccgucuacuacugccagcacuacggcuccucccucaccuucggcggcggcaccaaggucgagaucaag

SEQ ID NO: 15726 - RNA, 369 nt, Artificial Sequence
  derived and/or modified sequence opt2 from HuMab_LC5002-007__gamma1-Chain_V-Region
cagguccagcucguccaguccggcgccgaggucaagaagcccggcuccuccgucaaggucuccugcaaggucuccggcggcaccuucuccuccuacgccuucuccuggguccgccaggcccccggccagggccucgaguggaugggccgcaucauccccauccucggccgcaccaacuacgcccagaaguuccagggccgcgucaccaucaccgccgacaaguccaccuccaccgccuacauggaggucuccucccuccgcuccgaggacaccgccgucuacuacugcgcccgcgagggcgagacccucgacuacuucuacuacggcauggacgucuggggccagggcaccaccgucaccgucuccucc

SEQ ID NO: 15727 - RNA, 357 nt, Artificial Sequence
  derived and/or modified sequence opt2 from HuMab_LC5002-018_gamma1-Chain_V-Region
gagguccagcuccucgaguccggcggcggccucguccagcccggcggcucccuccgccucuccugcgccgccuccggcuucaccuucaacaucuacgccaugaacuggguccgccaggcccccggcaagggccucgagugggucuccgucaucuccggcuccggcgucaccaccuacuacgccgacuccgucaagggccgcuucaccaucucccgcgacaacuccaagaacacccucuaccuccagaugaacucccuccgcgccgaggacaccgccgucuacuacugcgccaagggcuccuccugguacgucgacuucgacuacuggggccagggcacccucgucaccgucuccucc

SEQ ID NO: 15728 - RNA, 1347 nt, Artificial Sequence
  derived and/or modified sequence opt2 from Ibalizumab_HeavyChain1
cagguccagcuccagcaguccggccccgaggucgucaagcccggcgccuccgucaagauguccugcaaggccuccggcuacaccuucaccuccuacgucauccacuggguccgccagaagcccggccagggccucgacuggaucggcuacaucaaccccuacaacgacggcaccgacuacgacgagaaguucaagggcaaggccacccucaccuccgacaccuccaccuccaccgccuacauggagcucuccucccuccgcuccgaggacaccgccgucuacuacugcgcccgcgagaaggacaacuacgccaccggcgccugguucgccuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15729 - RNA, 657 nt, Artificial Sequence
  derived and/or modified sequence opt2 from Ibalizumab_LightChain1
gacaucgucaugacccagucccccgacucccucgccgucucccucggcgagcgcgucaccaugaacugcaaguccucccagucccuccucuacuccaccaaccagaagaacuaccucgccugguaccagcagaagcccggccagucccccaagcuccucaucuacugggccuccacccgcgaguccggcguccccgaccgcuucuccggcuccggcuccggcaccgacuucacccucaccaucuccuccguccaggccgaggacgucgccgucuacuacugccagcaguacuacuccuaccgcaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15730 - RNA, 1329 nt, Artificial Sequence
  derived and/or modified sequence opt2 from Ibritumomab_tiuxetan_HeavyChain
caggccuaccuccagcaguccggcgccgagcucguccgccccggcgccuccgucaagauguccugcaaggccuccggcuacaccuucaccuccuacaacaugcacugggucaagcagaccccccgccagggccucgaguggaucggcgccaucuaccccggcaacggcgacaccuccuacaaccagaaguucaagggcaaggccacccucaccgucgacaaguccuccuccaccgccuacaugcagcucuccucccucaccuccgaggacuccgccgucuacuucugcgcccgcgucgucuacuacuccaacuccuacugguacuucgacgucuggggcaccggcaccaccgucaccgucuccgcccccuccgucuacccccucgcccccgucugcggcgacaccaccggcuccuccgucacccucggcugccucgucaagggcuacuuccccgagcccgucacccucaccuggaacuccggcucccucuccuccggcguccacaccuuccccgccguccuccaguccgaccucuacacccucuccuccuccgucaccgucaccuccuccaccuggcccucccaguccaucaccugcaacgucgcccaccccgccuccuccaccaaggucgacaagaagaucgagccccgcggccccaccaucaagcccugcccccccugcaagugccccgcccccaaccuccucggcggccccuccgucuucaucuucccccccaagaucaaggacguccucaugaucucccucucccccaucgucaccugcgucgucgucgacgucuccgaggacgaccccgacguccagaucuccugguucgucaacaacgucgagguccacaccgcccagacccagacccaccgcgaggacuacaacuccacccuccgcgucgucuccgcccuccccauccagcaccaggacuggauguccggcaaggaguucaagugcaaggucaacaacaaggaccuccccgcccccaucgagcgcaccaucuccaagcccaagggcuccguccgcgccccccaggucuacguccuccccccccccgaggaggagaugaccaagaagcaggucacccucaccugcauggucaccgacuucaugcccgaggacaucuacgucgaguggaccaacaacggcaagaccgagcucaacuacaagaacaccgagcccguccucgacuccgacggcuccuacuucauguacuccaagcuccgcgucgagaagaagaacugggucgagcgcaacuccuacuccugcuccgucguccacgagggccuccacaaccaccacaccaccaaguccuucucccgc

SEQ ID NO: 15731 - RNA, 627 nt, Artificial Sequence
  derived and/or modified sequence opt2 from Ibritumomab_tiuxetan_LightChain
cagaucguccucucccagucccccgccauccucuccgccucccccggcgagaaggucaccaugaccugccgcgccuccuccuccgucuccuacaugcacugguaccagcagaagcccggcuccucccccaagcccuggaucuacgcccccuccaaccucgccuccggcguccccgcccgcuucuccggcuccggcuccggcaccuccuacucccucaccaucucccgcgucgaggccgaggacgccgccaccuacuacugccagcagugguccuucaacccccccaccuucggcgccggcaccaagcucgagcucaagcgcgccgacgccgcccccaccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaac

SEQ ID NO: 15732 - RNA, 1368 nt, Artificial Sequence
  derived and/or modified sequence opt2 from Icrucumab_HeavyChain1
caggcccaggucgucgaguccggcggcggcgucguccaguccggccgcucccuccgccucuccugcgccgccuccggcuucgccuucuccuccuacggcaugcacuggguccgccaggcccccggcaagggccucgagugggucgccgucaucugguacgacggcuccaacaaguacuacgccgacuccguccgcggccgcuucaccaucucccgcgacaacuccgagaacacccucuaccuccagaugaacucccuccgcgccgaggacaccgccgucuacuacugcgcccgcgaccacuacggcuccggcguccaccacuacuucuacuacggccucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15733 - RNA, 645 nt, Artificial Sequence
  derived and/or modified sequence opt2 from Icrucumab_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15734 - RNA, 675 nt, Artificial Sequence
  derived and/or modified sequence opt2 from Idarucizumab_HeavyChain1
cagguccagcuccaggaguccggccccggccucgucaagcccuccgagacccucucccucaccugcaccgucuccggcuucucccucaccuccuacaucgucgacuggauccgccagccccccggcaagggccucgaguggaucggcgucaucugggccggcggcuccaccggcuacaacuccgcccuccgcucccgcgucuccaucaccaaggacaccuccaagaaccaguucucccucaagcucuccuccgucaccgccgccgacaccgccgucuacuacugcgccuccgccgccuacuacuccuacuacaacuacgacggcuucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 15735 - RNA, 657 nt, Artificial Sequence
  derived and/or modified sequence opt2 from Idarucizumab_LightChain1
gacgucgucaugacccaguccccccucucccuccccgucacccucggccagcccgccuccaucuccugcaaguccucccagucccuccucuacaccgacggcaagaccuaccucuacugguuccuccagcgccccggccaguccccccgccgccucaucuaccucgucuccaagcucgacuccggcguccccgaccgcuucuccggcuccggcuccggcaccgacuucacccucaagaucucccgcgucgaggccgaggacgucggcgucuacuacugccuccaguccacccacuucccccacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15736 - RNA, 1332 nt, Artificial Sequence
  derived and/or modified sequence opt2 from Igatuzuab_HeavyChain1
cagguccagcucguccaguccggcgccgaggucaagaagcccggcuccuccgucaaggucuccugcaaggccuccggcuucaccuucaccgacuacaagauccacuggguccgccaggcccccggccagggccucgaguggggcuacuucaaccccaacuccggcuacuccaccuacgcccagaaguuccagggccgcgucaccaucaccgccgacaaguccaccuccaccgccuacgagcucuccucccuccgcuccgaggacaccgccgucuacuacugcgcccgccucucccccggcggcuacuacgucgacgccuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 15737 - RNA, 636 nt, Artificial Sequence
  derived and/or modified sequence opt2 from Igatuzuab_LightChain1
gacauccagacccagucccccuccucccucuccgccuccgucggcgaccgcgucaccaucaccugccgcgccucccagggcaucaacaacuaccucaacugguaccagcagaagcccggcaaggcccccaagcgccucaucuacaacaccaacaaccuccagaccggcguccccucccgcuucuccggcuccggcuccggcaccgaguucacccucaccaucuccucccuccagcccgaggacuucgccaccuacuacugccuccagcacaacuccuuccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15738 - RNA, 357 nt, Artificial Sequence
  derived and/or modified sequence opt2 from IGF-IR_HUMAB-1A_HeavyChain
gagguccagcucguccaguccggcggcggccucguccaccccggcggcucccuccgccucuccugcgccggcuccggcuucaccuuccgcaacuacgccauguacuggguccgccaggcccccggcaagggccucgagugggucuccgccaucggcuccggcggcggcaccuacuacgccgacuccgucaagggccgcuucaccaucucccgcgacaacgccaagaacucccucuaccuccagaugaacucccuccgcgccgaggacauggccgucuacuacugcgcccgcgcccccaacuggggcuccgacgccuucgacaucuggggccagggcaccauggucaccgucuccucc

SEQ ID NO: 15739 - RNA, 357 nt, Artificial Sequence
  derived and/or modified sequence opt2 from IGF-IR_HUMAB-23_HeavyChain
gagguccagcucguccaguccggcggcggccucguccaccccggcggcucccuccgccucuccugcgccggcuccggcuucaccuucuccaacuacgccauguacuggguccgccaggcccccggcaagggccucgagugggucuccgccaucggcuccggcggcggcaccuacuacgccgacuccgucaagggccgcuucaccaucucccgcgacaacgccaagaacucccucuaccuccagaugaacucccuccgcgccgaggacauggccgucuaccacugcgcccgcgcccccaacuggggcuccgaggccuucgacaucuggggccagggcaccauggucaccgucuccucc

SEQ ID NO: 15740 - RNA, 321 nt, Artificial Sequence; identical to SEQ ID NO: 15636
  derived and/or modified sequence opt2 from IGF-IR_HUMAB-23_LightChain

SEQ ID NO: 15741 - RNA, 357 nt, Artificial Sequence
  derived and/or modified sequence opt2 from IGF-IR_HUMAB-8_HeavyChain
gagguccagcucguccaguccggcggcggccucguccaccccggcggcucccuccgccucuccugcgccggcuccggcuucaccuuccgcuccuacgccauguacuggguccgccaggcccccggcaagggccucgagugggucuccgccaucggcuccggcggcggcaccuacuacgccgacuccgucaagggccgcuucaccaucucccgcgacaacgccaagaacucccucuaccuccagaugaacucccuccgcgccgaggacauggccgucuacuacugcgcccgcgcccccaacuggggcuccgacgccuucgacaucuggggccagggcaccauggucaccgucuccucc

SEQ ID NO: 15742 - RNA, 321 nt, Artificial Sequence
  derived and/or modified sequence opt2 from IGF-IR_HUMAB-8_LightChain
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuacccccccaccuucggccccggcaccaaggucgacaucaag

SEQ ID NO: 15743 - RNA, 708 nt, Artificial Sequence
  derived and/or modified sequence opt2 from ImAb1_LightChain
auggacaugcgcgcccccgcccaguucuucggcauccuccuccucugguuccccggcauccgcugcgacaucaagaugacccagucccccuccuccauguacgccucccucggcgagcgcgucaccaucaccugcaaggccucccaggacaucaaguccuaccucuccugguaccagcagaagcccuggaagucccccaagauccucaucuacuacgccaccucccucgccgacggcguccccucccgcaucuccggcuccggcuccggccaggacuacucccucaccaucuccucccucgaguccgacgacaccgccaccuacuacugccuccagcacggcgagucccccuacaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15744 - RNA, 681 nt, Artificial Sequence
  derived and/or modified sequence opt2 from ImAb1_gamma1-Chain
augaacuucggcuucucccucaucuuccucguccucguccucaagggcguccagugcgaggucaagcucgucgaguccggcggcggccucgucaagcccggcggcucccucaagcucuccugcgccgccuccggcuucaccuucuccaacuacgccauguccuggguccgccagacccccgagaagcgccucgagugggucgccuccaucuccuccgacggcgacaccuacuuccccgacaacgucaagggccgcuucaccaucucccgcgagaacgccggcaacauccucuuccuccagauguccucccuccgcuccgaggacaccgccauguacuacugcgcccgcggcuucaugaucaccuucuggggccagggcacccucgucaccgucuccgccgccaagaccaccccccccuccgucuacccccucgcccccggcugcggcgacaccaccggcuccuccgucacccucggcugccucgucaagggcuacuuccccgaguccgucaccgucaccuggaacuccggcucccucuccuccuccguccacaccuuccccgcccuccuccaguccggccucuacaccauguccuccuccgucaccguccccuccuccaccuggcccucccagaccgucaccugcuccgucgcccaccccgccuccuccaccaccgucgac

SEQ ID NO: 15745 - RNA, 1344 nt, Artificial Sequence
  derived and/or modified sequence opt2 from Imalumab_HeavyChain1
gagguccagcuccucgaguccggcggcggccucguccagcccggcggcucccuccgccucuccugcgccgccuccggcuucaccuucuccaucuacuccaugaacuggguccgccaggcccccggcaagggccucgagugggucuccuccaucggcuccuccggcggcaccaccuacuacgccgacuccgucaagggccgcuucaccaucucccgcgacaacuccaagaacacccucuaccuccagaugaacucccuccgcgccgaggacaccgccgucuacuacugcgccggcucccaguggcucuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15746 - RNA, 642 nt, Artificial Sequence
  derived and/or modified sequence opt2 from Imalumab_LightChain1
gacauccagaugacccagucccccuccucccucuccgccuccgucggcgaccgcgucaccaucaccugccgcuccucccagcgcaucaugaccuaccucaacugguaccagcagaagcccggcaaggcccccaagcuccucaucuucgucgccucccacucccaguccggcguccccucccgcuuccgcggcuccggcuccgagaccgacuucacccucaccaucuccggccuccagcccgaggacuccgccaccuacuacugccagcaguccuucuggaccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15747 - RNA, 1347 nt, Artificial Sequence
  derived and/or modified sequence opt2 from Imgatuzumab_HeavyChain1
cagguccagcucguccaguccggcgccgaggucaagaagcccggcuccuccgucaaggucuccugcaaggccuccggcuucaccuucaccgacuacaagauccacuggguccgccaggcccccggccagggccucgaguggaugggcuacuucaaccccaacuccggcuacuccaccuacgcccagaaguuccagggccgcgucaccaucaccgccgacaaguccaccuccaccgccuacauggagcucuccucccuccgcuccgaggacaccgccgucuacuacugcgcccgccucucccccggcggcuacuacgucauggacgccuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15748 - RNA, 639 nt, Artificial Sequence
  derived and/or modified sequence opt2 from Imgatuzumab_LightChain1
gacauccagaugacccagucccccuccucccucuccgccuccgucggcgaccgcgucaccaucaccugccgcgccucccagggcaucaacaacuaccucaacugguaccagcagaagcccggcaaggcccccaagcgccucaucuacaacaccaacaaccuccagaccggcguccccucccgcuucuccggcuccggcuccggcaccgaguucacccucaccaucuccucccuccagcccgaggacuucgccaccuacuacugccuccagcacaacuccuuccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15749 - RNA, 1353 nt, Artificial Sequence
  derived and/or modified sequence opt2 from Inclacumab_HeavyChain1
gagguccagcucgucgaguccggcggcggccucguccgccccggcggcucccuccgccucuccugcgccgccuccggcuucaccuucuccaacuacgacaugcacuggguccgccaggccaccggcaagggccucgagugggucuccgccaucaccgccgccggcgacaucuacuaccccggcuccgucaagggccgcuucaccaucucccgcgagaacgccaagaacucccucuaccuccagaugaacucccuccgcgccggcgacaccgccgucuacuacugcgcccgcggccgcuacuccggcuccggcuccuacuacaacgacugguucgaccccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguucgagggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15750 - RNA, 642 nt, Artificial Sequence
  derived and/or modified sequence opt2 from Inclacumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15751 - RNA, 1347 nt, Artificial Sequence
  derived and/or modified sequence opt2 from Indatuximab_ravtansine_HeavyChain1
cagguccagcuccagcaguccggcuccgagcucaugaugcccggcgccuccgucaagaucuccugcaaggccaccggcuacaccuucuccaacuacuggaucgagugggucaagcagcgccccggccacggccucgaguggaucggcgagauccuccccggcaccggccgcaccaucuacaacgagaaguucaagggcaaggccaccuucaccgccgacaucuccuccaacaccguccagaugcagcucuccucccucaccuccgaggacuccgccgucuacuacugcgcccgccgcgacuacuacggcaacuucuacuacgccauggacuacuggggccagggcaccuccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15752 - RNA, 642 nt, Artificial Sequence
  derived and/or modified sequence opt2 from Indatuximab_ravtansine_LightChain1
gacauccagaugacccaguccaccuccucccucuccgccucccucggcgaccgcgucaccaucuccugcuccgccucccagggcaucaacaacuaccucaacugguaccagcagaagcccgacggcaccgucgagcuccucaucuacuacaccuccacccuccaguccggcguccccucccgcuucuccggcuccggcuccggcaccgacuacucccucaccaucuccaaccucgagcccgaggacaucggcaccuacuacugccagcaguacuccaagcucccccgcaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15753 - RNA, 1347 nt, Artificial Sequence
  derived and/or modified sequence opt2 from Indusatumab_vedotin_HeavyChain1
cagguccagcuccagcaguggggcgccggccuccucaagcccuccgagacccucucccucaccugcgccgucuucggcggcuccuucuccggcuacuacugguccuggauccgccagccccccggcaagggccucgaguggaucggcgagaucaaccaccgcggcaacaccaacgacaaccccucccucaagucccgcgucaccaucuccgucgacaccuccaagaaccaguucgcccucaagcucuccuccgucaccgccgccgacaccgccgucuacuacugcgcccgcgagcgcggcuacaccuacggcaacuucgaccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15754 - RNA, 642 nt, Artificial Sequence
  derived and/or modified sequence opt2 from Indusatumab_vedotin_LightChain1
gagaucgucaugacccagucccccgccacccucuccgucucccccggcgagcgcgccacccucuccugccgcgccucccaguccgucucccgcaaccucgccugguaccagcagaagcccggccaggccccccgccuccucaucuacggcgccuccacccgcgccaccggcauccccgcccgcuucuccggcuccggcuccggcaccgaguucacccucaccaucggcucccuccaguccgaggacuucgccgucuacuacugccagcaguacaagaccuggccccgcaccuucggccagggcaccaacgucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15755 - RNA, 1353 nt, Artificial Sequence
  derived and/or modified sequence opt2 from Inebilizumab_HeavyChain1
gagguccagcucgucgaguccggcggcggccucguccagcccggcggcucccuccgccucuccugcgccgccuccggcuucaccuucuccuccuccuggaugaacuggguccgccaggcccccggcaagggccucgagugggucggccgcaucuaccccggcgacggcgacaccaacuacaacgucaaguucaagggccgcuucaccaucucccgcgacgacuccaagaacucccucuaccuccagaugaacucccucaagaccgaggacaccgccgucuacuacugcgcccgcuccggcuucaucaccaccguccgcgacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15756 - RNA, 654 nt, Artificial Sequence
  derived and/or modified sequence opt2 from Inebilizumab_LightChain1
gagaucguccucacccagucccccgacuuccaguccgucacccccaaggagaaggucaccaucaccugccgcgccuccgaguccgucgacaccuucggcaucuccuucaugaacugguuccagcagaagcccgaccagucccccaagcuccucauccacgaggccuccaaccagggcuccggcguccccucccgcuucuccggcuccggcuccggcaccgacuucacccucaccaucaacucccucgaggccgaggacgccgccaccuacuacugccagcaguccaaggagguccccuucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15757 - RNA, 90 nt, Artificial Sequence
  derived and/or modified sequence opt2 from Insulin_peglispro_Fragment1
uucgucaaccagcaccucugcggcucccaccucgucgaggcccucuaccucgucugcggcgagcgcggcuucuucuacaccaagcccacc

SEQ ID NO: 15758 - RNA, 63 nt, Artificial Sequence
  derived and/or modified sequence opt2 from Insulin_peglispro_Fragment2
ggcaucgucgagcagugcugcaccuccaucugcucccucuaccagcucgagaacuacugcaac

SEQ ID NO: 15759 - RNA, 495 nt, Artificial Sequence
  derived and/or modified sequence opt2 from Interferon_beta-1b_chain1
uccuacaaccuccucggcuuccuccagcgcuccuccaacuuccagucccagaagcuccucuggcagcucaacggccgccucgaguacugccucaaggaccgcaugaacuucgacauccccgaggagaucaagcagcuccagcaguuccagaaggaggacgccgcccucaccaucuacgagaugcuccagaacaucuucgccaucuuccgccaggacuccuccuccaccggcuggaacgagaccaucgucgagaaccuccucgccaacgucuaccaccagaucaaccaccucaagaccguccucgaggagaagcucgagaaggaggacuucacccgcggcaagcucauguccucccuccaccucaagcgcuacuacggccgcauccuccacuaccucaaggccaaggaguacucccacugcgccuggaccaucguccgcgucgagauccuccgcaacuucuacuucaucaaccgccucaccggcuaccuccgcaac

SEQ ID NO: 15760 - RNA, 1347 nt, Artificial Sequence
  derived and/or modified sequence opt2 from Intetumumab_HeavyChain1
cagguccagcucgucgaguccggcggcggcgucguccagcccggccgcucccgccgccucuccugcgccgccuccggcuucaccuucucccgcuacaccaugcacuggguccgccaggcccccggcaagggccucgagugggucgccgucaucuccuucgacggcuccaacaaguacuacgucgacuccgucaagggccgcuucaccaucucccgcgacaacuccgagaacacccucuaccuccaggucaacauccuccgcgccgaggacaccgccgucuacuacugcgcccgcgaggcccgcggcuccuacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15761 - RNA, 645 nt, Artificial Sequence
  derived and/or modified sequence opt2 from Intetumumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15762 - RNA, 1347 nt, Artificial Sequence; identical to SEQ ID NO: 15620
  derived and/or modified sequence opt2 from Iodine_(124I)_Girentuximab_HeavyChain1

SEQ ID NO: 15763 - RNA, 642 nt, Artificial Sequence; identical to SEQ ID NO: 15621
  derived and/or modified sequence opt2 from Iodine_(124I)_Girentuximab_LightChain1

SEQ ID NO: 15764 - RNA, 1335 nt, Artificial Sequence
  derived and/or modified sequence opt2 from Iodine_(131I)_derlotuxiab_biotin_HeavyChain1
cagguccagcucaaggaguccggccccggccucgucgcccccucccagucccucuccaucaccugcaccgucuccggcuucucccucaccgacuacggcguccgcuggauccgccagccccccggcaagggccucgaguggcucggcgucaucuggggcggcggcuccaccuacuacaacuccgcccucaagucccgccucuccaucuccaaggacaacuccaagucccaggucuuccucaagaacucccuccagaccgacgacaccgccuacuacugcgccaaggagaagcgccgcggcuacuacuacgccgacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 15765 - RNA, 639 nt, Artificial Sequence
  derived and/or modified sequence opt2 from Iodine_(131I)_derlotuxiab_biotin_LightChain1
gagaacguccucacccagucccccgccaucuccgccucccccggcgagaaggucaccaccugccgcgccuccuccuccgucuccuccuccuaccuccacugguaccagcagaaguccggcgccucccccaagcucuggaucuacuccaccuccaaccucgccuccggcguccccgcccgcuucuccggcuccggcuccggcaccuccuacucccucaccaucuccuccgucgaggccgaggacgccgccaccuacuacugccagcaguacuccggcuacccccucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15766 - RNA, 1350 nt, Artificial Sequence
  derived and/or modified sequence opt2 from Iodine_(131I)_Derlotuximab_biotin_HeavyChain1
cagguccagcucaaggaguccggccccggccucgucgcccccucccagucccucuccaucaccugcaccgucuccggcuucucccucaccgacuacggcguccgcuggauccgccagccccccggcaagggccucgaguggcucggcgucaucuggggcggcggcuccaccuacuacaacuccgcccucaagucccgccucuccaucuccaaggacaacuccaagucccaggucuuccucaagaugaacucccuccagaccgacgacaccgccauguacuacugcgccaaggagaagcgccgcggcuacuacuacgccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15767 - RNA, 645 nt, Artificial Sequence
  derived and/or modified sequence opt2 from Iodine_(131I)_Derlotuximab_biotin_LightChain1
gagaacguccucacccagucccccgccaucauguccgccucccccggcgagaaggucaccaugaccugccgcgccuccuccuccgucuccuccuccuaccuccacugguaccagcagaaguccggcgccucccccaagcucuggaucuacuccaccuccaaccucgccuccggcguccccgcccgcuucuccggcuccggcuccggcaccuccuacucccucaccaucuccuccgucgaggccgaggacgccgccaccuacuacugccagcaguacuccggcuacccccucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15768 - RNA, 1344 nt, Artificial Sequence
  derived and/or modified sequence opt2 from Ipilimumab_HeavyChain
cagguccagcucgucgaguccggcggcggcgucguccagcccggccgcucccuccgccucuccugcgccgccuccggcuucaccuucuccuccuacaccaugcacuggguccgccaggcccccggcaagggccucgagugggucaccuucaucuccuacgacggcaacaacaaguacuacgccgacuccgucaagggccgcuucaccaucucccgcgacaacuccaagaacacccucuaccuccagaugaacucccuccgcgccgaggacaccgccaucuacuacugcgcccgcaccggcuggcucggccccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15769 - RNA, 645 nt, Artificial Sequence
  derived and/or modified sequence opt2 from Ipilimumab_LightChain
gagaucguccucacccagucccccggcacccucucccucucccccggcgagcgcgccacccucuccugccgcgccucccaguccgucggcuccuccuaccucgccugguaccagcagaagcccggccaggccccccgccuccucaucuacggcgccuucucccgcgccaccggcauccccgaccgcuucuccggcuccggcuccggcaccgacuucacccucaccaucucccgccucgagcccgaggacuucgccgucuacuacugccagcaguacggcuccucccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15770 - RNA, 186 nt, Artificial Sequence
  derived and/or modified sequence opt2 from Iratumumab_HeavyChain1
cagguccagcuccagcaguggggcgccggccuccucaagcccuccgagacccucucccucaccugcgccgucuacggcggcuccuucuccgccuacuacugguccuggauccgccagccccccggcaagggccucgaguggaucggcgacuacuggggccagggcucccucgucaccgucuccucc

SEQ ID NO: 15771 - RNA, 321 nt, Artificial Sequence
  derived and/or modified sequence opt2 from Iratumumab_LightChain1
gacauccagaugacccagucccccaccucccucuccgccuccgucggcgaccgcgucaccaucaccugccgcgccucccagggcaucuccuccuggcucaccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacgacuccuaccccaucaccuucggccagggcacccgccucgagaucaag

SEQ ID NO: 15772 - RNA, 1350 nt, Artificial Sequence
  derived and/or modified sequence opt2 from Isatuximab_HeavyChain1
cagguccagcucguccaguccggcgccgaggucgccaagcccggcaccuccgucaagcucuccugcaaggccuccggcuacaccuucaccgacuacuggaugcagugggucaagcagcgccccggccagggccucgaguggaucggcaccaucuaccccggcgacggcgacaccggcuacgcccagaaguuccagggcaaggccacccucaccgccgacaaguccuccaagaccgucuacaugcaccucuccucccucgccuccgaggacuccgccgucuacuacugcgcccgcggcgacuacuacggcuccaacucccucgacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15773 - RNA, 642 nt, Artificial Sequence
  derived and/or modified sequence opt2 from Isatuximab_LightChain1
gacaucgucaugacccagucccaccucuccauguccaccucccucggcgaccccgucuccaucaccugcaaggccucccaggacgucuccaccgucgucgccugguaccagcagaagcccggccaguccccccgccgccucaucuacuccgccuccuaccgcuacaucggcguccccgaccgcuucaccggcuccggcgccggcaccgacuucaccuucaccaucuccuccguccaggccgaggaccucgccgucuacuacugccagcagcacuacuccccccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15774 - RNA, 1347 nt, Artificial Sequence
  derived and/or modified sequence opt2 from Itolizumab_HeavyChain1
gagguccagcucgucgaguccggcggcggccucgucaagcccggcggcucccucaagcucuccugcgccgccuccggcuucaaguucucccgcuacgccauguccuggguccgccaggcccccggcaagcgccucgagugggucgccaccaucuccuccggcggcuccuacaucuacuaccccgacuccgucaagggccgcuucaccaucucccgcgacaacgucaagaacacccucuaccuccagauguccucccuccgcuccgaggacaccgccauguacuacugcgcccgccgcgacuacgaccucgacuacuucgacuccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15775 - RNA, 642 nt, Artificial Sequence
  derived and/or modified sequence opt2 from Itolizumab_LightChain1
gacauccagaugacccagucccccuccucccucuccgccuccgucggcgaccgcgucaccaucaccugcaaggccucccgcgacauccgcuccuaccucaccugguaccagcagaagcccggcaaggcccccaagacccucaucuacuacgccaccucccucgccgacggcguccccucccgcuucuccggcuccggcuccggccaggacuacucccucaccaucuccucccucgaguccgacgacaccgccaccuacuacugccuccagcacggcgagucccccuucacccucggcuccggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15776 - RNA, 1335 nt, Artificial Sequence
  derived and/or modified sequence opt2 from Ixekizumab_HeavyChain1
cagguccagcucguccaguccggcgccgaggucaagaagcccggcuccuccgucaaggucuccugcaaggccuccggcuacuccuucaccgacuaccacauccacuggguccgccaggcccccggccagggccucgaguggaugggcgucaucaaccccauguacggcaccaccgacuacaaccagcgcuucaagggccgcgucaccaucaccgccgacgaguccaccuccaccgccuacauggagcucuccucccuccgcuccgaggacaccgccgucuacuacugcgcccgcuacgacuacuucaccggcaccggcgucuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15777 - RNA, 657 nt, Artificial Sequence
  derived and/or modified sequence opt2 from Ixekizumab_LightChain1
gacaucgucaugacccagaccccccucucccucuccgucacccccggccagcccgccuccaucuccugccgcuccucccgcucccucguccacucccgcggcaacaccuaccuccacugguaccuccagaagcccggccaguccccccagcuccucaucuacaaggucuccaaccgcuucaucggcguccccgaccgcuucuccggcuccggcuccggcaccgacuucacccucaagaucucccgcgucgaggccgaggacgucggcgucuacuacugcucccaguccacccaccuccccuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15778 - RNA, 1347 nt, Artificial Sequence
  derived and/or modified sequence opt2 from Labetuzumab_govitecan_HeavyChain1
gagguccagcucgucgaguccggcggcggcgucguccagcccggccgcucccuccgccucuccugcuccgccuccggcuucgacuucaccaccuacuggauguccuggguccgccaggcccccggcaagggccucgaguggaucggcgagauccaccccgacuccuccaccaucaacuacgcccccucccucaaggaccgcuucaccaucucccgcgacaacgccaagaacacccucuuccuccagauggacucccuccgccccgaggacaccggcgucuacuucugcgccucccucuacuucggcuuccccugguucgccuacuggggccagggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15779 - RNA, 639 nt, Artificial Sequence
  derived and/or modified sequence opt2 from Labetuzumab_govitecan_LightChain1
gacauccagcucacccagucccccuccucccucuccgccuccgucggcgaccgcgucaccaucaccugcaaggccucccaggacgucggcaccuccgucgccugguaccagcagaagcccggcaaggcccccaagcuccucaucuacuggaccuccacccgccacaccggcguccccucccgcuucuccggcuccggcuccggcaccgacuucaccuucaccaucuccucccuccagcccgaggacaucgccaccuacuacugccagcaguacucccucuaccgcuccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15780 - RNA, 1341 nt, Artificial Sequence
  derived and/or modified sequence opt2 from Lambrolizumab_HeavyChain1
cagguccagcucguccaguccggcgucgaggucaagaagcccggcgccuccgucaaggucuccugcaaggccuccggcuacaccuucaccaacuacuacauguacuggguccgccaggcccccggccagggccucgaguggaugggcggcaucaaccccuccaacggcggcaccaacuucaacgagaaguucaagaaccgcgucacccucaccaccgacuccuccaccaccaccgccuacauggagcucaagucccuccaguucgacgacaccgccgucuacuacugcgcccgccgcgacuaccgcuucgacaugggcuucgacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15781 - RNA, 654 nt, Artificial Sequence
  derived and/or modified sequence opt2 from Lambrolizumab_LightChain1
gagaucguccucacccagucccccgccacccucucccucucccccggcgagcgcgccacccucuccugccgcgccuccaagggcgucuccaccuccggcuacuccuaccuccacugguaccagcagaagcccggccaggccccccgccuccucaucuaccucgccuccuaccucgaguccggcguccccgcccgcuucuccggcuccggcuccggcaccgacuucacccucaccaucuccucccucgagcccgaggacuucgccgucuacuacugccagcacucccgcgaccucccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15782 - RNA, 669 nt, Artificial Sequence
  derived and/or modified sequence opt2 from Lampalizumab_HeavyChain1
gagguccagcucguccaguccggccccgagcucaagaagcccggcgccuccgucaaggucuccugcaaggccuccggcuacaccuucaccaacuacggcaugaacuggguccgccaggcccccggccagggccucgaguggaugggcuggaucaacaccuacaccggcgagaccaccuacgccgacgacuucaagggccgcuucgucuucucccucgacaccuccgucuccaccgccuaccuccagaucuccucccucaaggccgaggacaccgccgucuacuacugcgagcgcgagggcggcgucaacaacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacacc

SEQ ID NO: 15783 - RNA, 642 nt, Artificial Sequence
  derived and/or modified sequence opt2 from Lampalizumab_LightChain1
gacauccaggucacccagucccccuccucccucuccgccuccgucggcgaccgcgucaccaucaccugcaucaccuccaccgacaucgacgacgacaugaacugguaccagcagaagcccggcaagguccccaagcuccucaucuccggcggcaacacccuccgccccggcguccccucccgcuucuccggcuccggcuccggcaccgacuucacccucaccaucuccucccuccagcccgaggacgucgccaccuacuacugccuccaguccgacucccuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15784 - RNA, 1353 nt, Artificial Sequence
  derived and/or modified sequence opt2 from Lanadelumab_HeavyChain1
gagguccagcuccucgaguccggcggcggccucguccagcccggcggcucccuccgccucuccugcgccgccuccggcuucaccuucucccacuacaucaugauguggguccgccaggcccccggcaagggccucgagugggucuccggcaucuacuccuccggcggcaucaccgucuacgccgacuccgucaagggccgcuucaccaucucccgcgacaacuccaagaacacccucuaccuccagaugaacucccuccgcgccgaggacaccgccgucuacuacugcgccuaccgccgcaucggcgucccccgccgcgacgaguucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15785 - RNA, 639 nt, Artificial Sequence
  derived and/or modified sequence opt2 from Lanadelumab_LightChain1
gacauccagaugacccagucccccuccacccucuccgccuccgucggcgaccgcgucaccaucaccugccgcgccucccaguccaucuccuccuggcucgccugguaccagcagaagcccggcaaggcccccaagcuccucaucuacaaggccuccacccucgaguccggcguccccucccgcuucuccggcuccggcuccggcaccgaguucacccucaccaucuccucccuccagcccgacgacuucgccaccuacuacugccagcaguacaacaccuacuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15786 - RNA, 1317 nt, Artificial Sequence
  derived and/or modified sequence opt2 from Landogrozumab_HeavyChain1
gagguccagcucgucgaguccggcggcggccucguccagcccggcggcucccuccgccucuccugcgccgccuccggccucaccuucucccgcuaccccauguccuggguccgccaggcccccggcaagggccucgucugggucuccgccaucaccuccuccggcggcuccaccuacuacuccgacaccgucaagggccgcuucaccaucucccgcgacaacgccaagaacacccucuaccuccagaugaacucccuccgcgccgaggacaccgccgucuacuacugcgcccgccuccccgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 15787 - RNA, 645 nt, Artificial Sequence
  derived and/or modified sequence opt2 from Landogrozumab_LightChain1
gagaucguccucacccagucccccggcacccucucccucucccccggcgagcgcgccacccucuccugccgcgccuccuccuccgucuccuccuccuaccuccacugguaccagcagaagcccggccaggccccccgccuccucaucuacuccaccuccaaccucgucgccggcauccccgaccgcuucuccggcuccggcuccggcaccgacuucacccucaccaucucccgccucgagcccgaggacuucgccgucuacuacugccagcaccacuccggcuaccacuucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15788 - RNA, 1344 nt, Artificial Sequence
  derived and/or modified sequence opt2 from Laprituximab_emtansine_HeavyChain1
cagguccagcucguccaguccggcgccgaggucgccaagcccggcgccuccgucaagcucuccugcaaggccuccggcuacaccuucaccuccuacuggaugcagugggucaagcagcgccccggccagggccucgagugcaucggcaccaucuaccccggcgacggcgacaccaccuacacccagaaguuccagggcaaggccacccucaccgccgacaaguccuccuccaccgccuacaugcagcucuccucccuccgcuccgaggacuccgccgucuacuacugcgcccgcuacgacgcccccggcuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15789 - RNA, 642 nt, Artificial Sequence
  derived and/or modified sequence opt2 from Laprituximab_emtansine_LightChain1
gacauccagaugacccagucccccuccucccucuccgccuccgucggcgaccgcgucaccaucaccugccgcgccucccaggacaucaacaacuaccucgccugguaccagcacaagcccggcaagggccccaagcuccucauccacuacaccuccacccuccaccccggcauccccucccgcuucuccggcuccggcuccggccgcgacuacuccuucuccaucuccucccucgagcccgaggacaucgccaccuacuacugccuccaguacgacaaccuccucuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15790 - RNA, 1314 nt, Artificial Sequence
  derived and/or modified sequence opt2 from Lealesoab_HeavyChain1
cagguccagcuccaggaguccggccccgagcucaagaagcccggcgagaccgucaagaucuccugcaaggccuccggcuacaccuuccgcaacuacggcaacugggucaagcaggcccccggcaagggccucaaguggggcuggaucaacaccuacaccggcgagcccaccuacgccgacgacuucaagggccgcuucgccuucucccucgagaccuccgccuccaccgccuaccuccagaucaacaacgucaagaacgaggacaccgccaccuacuucugcgcccgcaagggcugggacuucaacggcuccucccucgacuacuggggccagggcaccaccgucaccgucuccuccgccaagaccaccccccccuccgucuacccccucgcccccggcuccgccgcccagaccaacuccgucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccccccgccccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccauccaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcaggccaaggacaaggucucccucaccugcaucaccgacuucuuccccgaggacaucaccgucgaguggcaguggaacggccagcccgccgagaacuacaagaacacccagcccaucaacaccaacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 15791 - RNA, 654 nt, Artificial Sequence
  derived and/or modified sequence opt2 from Lealesoab_LightChain1
gacauccagcucacccagaccccccucucccuccccgucucccucggcgaccaggccuccaucuccugccgcuccucccaguccaucguccacuccaacggcaacaccuaccucgagugguaccuccagaagcccggccagucccccaaccuccucaucuacaaggucuccaaccgcuucuccggcguccccgaccgcuucuccggcuccggcuccggcaccgacuucacccucaagaucucccgcgucgaggccgaggaccucggcgucuacuacugcuuccagggcucccacgucccccccaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccuccuccacccucacccucaccaaggacgaguacgagcgccacaacuccuacaccugcgaggccacccacaagaccuccaccucccccaucgucaaguccuucaaccgcaacgagugc

SEQ ID NO: 15792 - RNA, 1335 nt, Artificial Sequence
  derived and/or modified sequence opt2 from Lebrikizumab_HeavyChain1
caggucacccuccgcgaguccggccccgcccucgucaagcccacccagacccucacccucaccugcaccgucuccggcuucucccucuccgccuacuccgucaacuggauccgccagccccccggcaaggcccucgaguggcucgccaugaucuggggcgacggcaagaucgucuacaacuccgcccucaagucccgccucaccaucuccaaggacaccuccaagaaccaggucguccucaccaugaccaacauggaccccgucgacaccgccaccuacuacugcgccggcgacggcuacuaccccuacgccauggacaacuggggccagggcucccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15793 - RNA, 654 nt, Artificial Sequence
  derived and/or modified sequence opt2 from Lebrikizumab_LightChain1
gacaucgucaugacccagucccccgacucccucuccgucucccucggcgagcgcgccaccaucaacugccgcgccuccaaguccgucgacuccuacggcaacuccuucaugcacugguaccagcagaagcccggccagccccccaagcuccucaucuaccucgccuccaaccucgaguccggcguccccgaccgcuucuccggcuccggcuccggcaccgacuucacccucaccaucuccucccuccaggccgaggacgucgccgucuacuacugccagcagaacaacgaggacccccgcaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15794 - RNA, 1227 nt, Artificial Sequence
  derived and/or modified sequence opt2 from Lenercept_chain1
cucgucccccaccucggcgaccgcgagaagcgcgacuccgucugcccccagggcaaguacauccacccccagaacaacuccaucugcugcaccaagugccacaagggcaccuaccucuacaacgacugccccggccccggccaggacaccgacugccgcgagugcgaguccggcuccuucaccgccuccgagaaccaccuccgccacugccucuccugcuccaagugccgcaaggagaugggccaggucgagaucuccuccugcaccgucgaccgcgacaccgucugcggcugccgcaagaaccaguaccgccacuacugguccgagaaccucuuccagugcuucaacugcucccucugccucaacggcaccguccaccucuccugccaggagaagcagaacaccgucugcaccugccacgccggcuucuuccuccgcgagaacgagugcgucuccugcuccaacugcaagaagucccucgagugcaccaagcucugccucccccagaucgagaacgucaagggcaccgaggacuccggcaccaccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15795 - RNA, 1347 nt, Artificial Sequence
  derived and/or modified sequence opt2 from Lenzilumab_HeavyChain1
cagguccagcucguccaguccggcgccgaggucaagaagcccggcgccuccgucaaggucuccugcaaggccuccggcuacuccuucaccaacuacuacauccacuggguccgccaggcccccggccagcgccucgaguggaugggcuggaucaacgccggcaacggcaacaccaaguacucccagaaguuccagggccgcgucaccaucacccgcgacaccuccgccuccaccgccuacauggagcucuccucccuccgcuccgaggacaccgccgucuacuacugcguccgccgccagcgcuuccccuacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15796 - RNA, 642 nt, Artificial Sequence
  derived and/or modified sequence opt2 from Lenzilumab_LightChain1
gagaucguccucacccagucccccgccacccucuccgucucccccggcgagcgcgccacccucuccugccgcgccucccaguccgucggcaccaacgucgccugguaccagcagaagcccggccaggccccccgcguccucaucuacuccaccuccucccgcgccaccggcaucaccgaccgcuucuccggcuccggcuccggcaccgacuucacccucaccaucucccgccucgagcccgaggacuucgccgucuacuacugccagcaguucaacaaguccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15797 - RNA, 1326 nt, Artificial Sequence
  derived and/or modified sequence opt2 from Lerdelimumab_HeavyChain1
gagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucugguacgacggcuccaacaaguacuacgccgacuccgucaagggccgcuucaccaucucccgcgacaacuccaagaacacccucuaccuccagauggacucccuccgcgccgaggacaccgccgucuacuacugcggccgcacccucgaguccucccucuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15798 - RNA, 645 nt, Artificial Sequence
  derived and/or modified sequence opt2 from Lerdelimumab_LightChain1
uccuccgagcucacccaggaccccgccgucuccgucgcccucggccagaccguccgcaucaccugccagggcgacucccuccgcuccuacuacgccuccugguaccagcagaagcccggccaggcccccguccucgucaucuacggcaagaacaaccgccccuccggcauccccgaccgcuucuccggcuccuccuccggcaacaccgccucccucaccaucaccggcgcccaggccgaggacgaggccgacuacuacugcaacucccgcgacuccuccuccacccaccgcggcgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15799 - RNA, 1353 nt, Artificial Sequence
  derived and/or modified sequence opt2 from Lexatumumab_HeavyChain1
gagguccagcucguccaguccggcggcggcgucgagcgccccggcggcucccuccgccucuccugcgccgccuccggcuucaccuucgacgacuacggcauguccuggguccgccaggcccccggcaagggccucgagugggucuccggcaucaacuggaacggcggcuccaccggcuacgccgacuccgucaagggccgcgucaccaucucccgcgacaacgccaagaacucccucuaccuccagaugaacucccuccgcgccgaggacaccgccgucuacuacugcgccaagauccucggcgccggccgcggcugguacuucgaccucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15800 - RNA, 1353 nt, Artificial Sequence; identical to SEQ ID NO: 15799
  derived and/or modified sequence opt2 from Lexatumumab_HeavyChain

SEQ ID NO: 15801 - RNA, 642 nt, Artificial Sequence
  derived and/or modified sequence opt2 from Lexatumumab_LightChain1
uccuccgagcucacccaggaccccgccgucuccgucgcccucggccagaccguccgcaucaccugccagggcgacucccuccgcuccuacuacgccuccugguaccagcagaagcccggccaggcccccguccucgucaucuacggcaagaacaaccgccccuccggcauccccgaccgcuucuccggcuccuccuccggcaacaccgccucccucaccaucaccggcgcccaggccgaggacgaggccgacuacuacugcaacucccgcgacuccuccggcaaccacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15802 - RNA, 642 nt, Artificial Sequence; identical to SEQ ID NO: 15801
  derived and/or modified sequence opt2 from Lexatumumab_LightChain

SEQ ID NO: 15803 - RNA, 1377 nt, Artificial Sequence
  derived and/or modified sequence opt2 from Libivirumab_HeavyChain1
cagguccagcucgucgaguccggcggcggcgucguccgccccggccgcucccuccgccucuccugcgccgccuccggcuucgccuucuccgacuacuccaucaacuggguccgccaggcccccggcaagggccucgagugggucgccaucaucuccuacgacggccgcaucaccuacuaccgcgacuccgucaagggccgcuucaccaucucccgcgacgacuccaagaacacccucuaccuccagaugaacucccuccgcaccgaggacaccgccgucuacuacugcgcccgccaguacuacgacuucugguccggcuccuccgucggccgcaacuacgacggcauggacgucuggggccucggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15804 - RNA, 657 nt, Artificial Sequence
  derived and/or modified sequence opt2 from Libivirumab_LightChain1
gacaucgucaugacccaguccccccucucccucuccgucacccccggcgagcccgccuccaucuccugccgcuccucccagucccuccuccaccgcuccggcaacaacuaccucgacugguaccuccagaagcccggccacuccccccagcuccucaucuacgucggcuccaaccgcgccuccggcguccccgaccgcuucuccggcuccggcuccggcaccgaguacacccucaagaucucccgcgucgaggccgaggacgucggcgucuacuacugcaugcaggcccuccagaccccccgcaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15805 - RNA, 1350 nt, Artificial Sequence
  derived and/or modified sequence opt2 from Lifastuzumab_HeavyChain
gagguccagcucgucgaguccggcggcggccucguccagcccggcggcucccuccgccucuccugcgccgccuccggcuucuccuucuccgacuucgccauguccuggguccgccaggcccccggcaagggccucgagugggucgccaccaucggccgcgucgccuuccacaccuacuaccccgacuccaugaagggccgcuucaccaucucccgcgacaacuccaagaacacccucuaccuccagaugaacucccuccgcgccgaggacaccgccgucuacuacugcgcccgccaccgcggcuucgacgucggccacuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15806 - RNA, 657 nt, Artificial Sequence
  derived and/or modified sequence opt2 from Lifastuzumab_LightChain
gacauccagaugacccagucccccuccucccucuccgccuccgucggcgaccgcgucaccaucaccugccgcuccuccgagacccucguccacuccuccggcaacaccuaccucgagugguaccagcagaagcccggcaaggcccccaagcuccucaucuaccgcgucuccaaccgcuucuccggcguccccucccgcuucuccggcuccggcuccggcaccgacuucacccucaccaucuccucccuccagcccgaggacuucgccaccuacuacugcuuccagggcuccuucaacccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15807 - RNA, 1347 nt, Artificial Sequence
  derived and/or modified sequence opt2 from Lifastuzumab_vedotin_HeavyChain1
guccagcucgucgaguccggcggcggccucguccagcccggcggcucccuccgccucuccugcgccgccuccggcuucuccuucuccgacuucgccauguccuggguccgccaggcccccggcaagggccucgagugggucgccaccaucggccgcgucgccuuccacaccuacuaccccgacuccaugaagggccgcuucaccaucucccgcgacaacuccaagaacacccucuaccuccagaugaacucccuccgcgccgaggacaccgccgucuacuacugcgcccgccaccgcggcuucgacgucggccacuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15808 - RNA, 657 nt, Artificial Sequence; identical to SEQ ID NO: 15806
  derived and/or modified sequence opt2 from Lifastuzumab_vedotin_LightChain1

SEQ ID NO: 15809 - RNA, 1359 nt, Artificial Sequence
  derived and/or modified sequence opt2 from Ligelizumab_HeavyChain1
cagguccagcucguccaguccggcgccgaggucaugaagcccggcuccuccgucaaggucuccugcaaggccuccggcuacaccuucuccugguacuggcucgaguggguccgccaggcccccggccacggccucgaguggaugggcgagaucgaccccggcaccuucaccaccaacuacaacgagaaguucaaggcccgcgucaccuucaccgccgacaccuccaccuccaccgccuacauggagcucuccucccuccgcuccgaggacaccgccgucuacuacugcgcccgcuucucccacuucuccggcuccaacuacgacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15810 - RNA, 642 nt, Artificial Sequence
  derived and/or modified sequence opt2 from Ligelizumab_LightChain1
gagaucgucaugacccagucccccgccacccucuccgucucccccggcgagcgcgccacccucuccugccgcgccucccaguccaucggcaccaacauccacugguaccagcagaagcccggccaggccccccgccuccucaucuacuacgccuccgaguccaucuccggcauccccgcccgcuucuccggcuccggcuccggcaccgaguucacccucaccaucuccucccuccaguccgaggacuucgccgucuacuacugccagcaguccugguccuggcccaccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15811 - RNA, 1329 nt, Artificial Sequence; identical to SEQ ID NO: 15359
  derived and/or modified sequence opt2 from Lilotomab_HeavyChain1

SEQ ID NO: 15812 - RNA, 642 nt, Artificial Sequence; identical to SEQ ID NO: 15360
  derived and/or modified sequence opt2 from Lilotomab_LightChain1

SEQ ID NO: 15813 - RNA, 1338 nt, Artificial Sequence
  derived and/or modified sequence opt2 from Lintuzumab_HeavyChain1
cagguccagcucguccaguccggcgccgaggucaagaagcccggcuccuccgucaaggucuccugcaaggccuccggcuacaccuucaccgacuacaacaugcacuggguccgccaggcccccggccagggccucgaguggaucggcuacaucuaccccuacaacggcggcaccggcuacaaccagaaguucaaguccaaggccaccaucaccgccgacgaguccaccaacaccgccuacauggagcucuccucccuccgcuccgaggacaccgccgucuacuacugcgcccgcggccgccccgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15814 - RNA, 654 nt, Artificial Sequence
  derived and/or modified sequence opt2 from Lintuzumab_LightChain1
gacauccagaugacccagucccccuccucccucuccgccuccgucggcgaccgcgucaccaucaccugccgcgccuccgaguccgucgacaacuacggcaucuccuucaugaacugguuccagcagaagcccggcaaggcccccaagcuccucaucuacgccgccuccaaccagggcuccggcguccccucccgcuucuccggcuccggcuccggcaccgacuucacccucaccaucuccucccuccagcccgacgacuucgccaccuacuacugccagcaguccaaggagguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15815 - RNA, 1350 nt, Artificial Sequence
  derived and/or modified sequence opt2 from Lirilumab_HeavyChain1
cagguccagcucguccaguccggcgccgaggucaagaagcccggcuccuccgucaaggucuccugcaaggccuccggcggcaccuucuccuucuacgccaucuccuggguccgccaggcccccggccagggccucgaguggaugggcggcuucauccccaucuucggcgccgccaacuacgcccagaaguuccagggccgcgucaccaucaccgccgacgaguccaccuccaccgccuacauggagcucuccucccuccgcuccgacgacaccgccgucuacuacugcgcccgcauccccuccggcuccuacuacuacgacuacgacauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15816 - RNA, 642 nt, Artificial Sequence
  derived and/or modified sequence opt2 from Lirilumab_LightChain1
gagaucguccucacccagucccccgucacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15817 - RNA, 1344 nt, Artificial Sequence
  derived and/or modified sequence opt2 from Lodelcizumab_HeavyChain1
cagguccagcucguccaguccggcgccgaggucaagaagcccggcgccuccgucaaggucuccugcaaggccuccggcuacaccuucuccaccauguacauguccuggguccgccaggcccccggccagggccucgaguggaugggccgcaucgaccccgccaacgagcacaccaacuacgcccagaaguuccagggccgcgucaccaugacccgcgacaccuccaucuccaccgccuacauggagcucucccgccucaccuccgacgacaccgccgucuacuacugcgcccgcuccuacuacuacuacaacauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15818 - RNA, 639 nt, Artificial Sequence
  derived and/or modified sequence opt2 from Lodelcizumab_LightChain1
cagaucguccucacccagucccccgccacccucuccgucucccccggcgagcgcgccacccucuccugccgcgccucccaguccgucuccuacaugcacugguaccagcagaagcccggccaggccccccgccuccucaucuacggcgucuuccgccgcgccaccggcauccccgaccgcuucuccggcuccggcuccggcaccgacuucacccucaccaucggccgccucgagcccgaggacuucgccgucuacuacugccuccagugguccuccgacccccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15819 - RNA, 1356 nt, Artificial Sequence
  derived and/or modified sequence opt2 from Lokivetmab_HeavyChain1
gagguccagcucgucgaguccggcggcgaccucgucaagcccggcggcucccuccgccucuccugcgucgccuccggcuucaccuucuccaacuacggcauguccuggguccgccaggcccccggcaagggccuccagugggucgccaccaucuccuacggcggcuccuacaccuacuaccccgacaacaucaagggccgcuucaccaucucccgcgacaacgccaagaacacccucuaccuccagaugaacucccuccgcgccgaggacaccgccauguacuacugcguccgcggcuacggcuacgacaccauggacuacuggggccagggcacccucgucaccgucuccuccgccuccaccaccgcccccuccgucuucccccucgcccccuccugcggcuccaccuccggcuccaccgucgcccucgccugccucgucuccggcuacuuccccgagcccgucaccgucuccuggaacuccggcucccucaccuccggcguccacaccuuccccuccguccuccaguccuccggccucuacucccucuccuccauggucaccguccccuccucccgcuggcccuccgagaccuucaccugcaacgucgcccaccccgccuccaagaccaaggucgacaagcccguccccaagcgcgagaacggccgcgucccccgcccccccgacugccccaagugccccgcccccgagaugcucggcggccccuccgucuucaucuucccccccaagcccaaggacacccuccucaucgcccgcacccccgaggucaccugcgucgucgucgaccucgaccccgaggaccccgagguccagaucuccugguucgucgacggcaagcagaugcagaccgccaagacccagccccgcgaggagcaguucaacggcaccuaccgcgucgucuccguccuccccaucggccaccaggacuggcucaagggcaagcaguucaccugcaaggucaacaacaaggcccuccccucccccaucgagcgcaccaucuccaaggcccgcggccaggcccaccagcccuccgucuacguccucccccccucccgcgaggagcucuccaagaacaccgucucccucaccugccucaucaaggacuucuucccccccgacaucgacgucgaguggcaguccaacggccagcaggagcccgaguccaaguaccgcaccacccccccccagcucgacgaggacggcuccuacuuccucuacuccaagcucuccgucgacaagucccgcuggcagcgcggcgacaccuucaucugcgccgucaugcacgaggcccuccacaaccacuacacccaggagucccucucccacucccccggc

SEQ ID NO: 15820 - RNA, 651 nt, Artificial Sequence
  derived and/or modified sequence opt2 from Lokivetmab_LightChain1
gagaucgucaugacccagucccccgccucccucucccucucccaggaggagaaggucaccaucaccugcaaggccucccaguccgucuccuucgccggcaccggccucaugcacugguaccagcagaagcccggccaggcccccaagcuccucaucuaccgcgccuccaaccucgaggccggcguccccucccgcuucuccggcuccggcuccggcaccgacuucuccuucaccaucuccucccucgagcccgaggacgucgccgucuacuacugccagcagucccgcgaguaccccuggaccuucggccagggcaccaagcucgagaucaagcgcaacgacgcccagcccgccgucuaccucuuccagcccucccccgaccagcuccacaccggcuccgccuccgucgucugccuccucaacuccuucuaccccaaggacaucaacgucaaguggaaggucgacggcgucauccaggacaccggcauccaggaguccgucaccgagcaggacaaggacuccaccuacucccucuccuccacccucaccauguccuccaccgaguaccucucccacgagcucuacuccugcgagaucacccacaagucccuccccuccacccucaucaaguccuuccagcgcuccgagugc

SEQ ID NO: 15821 - RNA, 1344 nt, Artificial Sequence
  derived and/or modified sequence opt2 from Lorvotuzumab_mertansine_HeavyChain1
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccuacaucuccuccggcuccuucaccaucuacuacgccgacuccgucaagggccgcuucaccaucucccgcgacaacuccaagaacacccucuaccuccagaugaacucccuccgcgccgaggacaccgccgucuacuacugcgcccgcaugcgcaagggcuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15822 - RNA, 657 nt, Artificial Sequence
  derived and/or modified sequence opt2 from Lorvotuzumab_mertansine_LightChain1
gacgucgucaugacccaguccccccucucccuccccgucacccucggccagcccgccuccaucuccugccgcuccucccagaucaucauccacuccgacggcaacaccuaccucgagugguuccagcagcgccccggccaguccccccgccgccucaucuacaaggucuccaaccgcuucuccggcguccccgaccgcuucuccggcuccggcuccggcaccgacuucacccucaagaucucccgcgucgaggccgaggacgucggcgucuacuacugcuuccagggcucccacgucccccacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15823 - RNA, 336 nt, Artificial Sequence
  derived and/or modified sequence opt2 from Lpathomab_VL
gacgucgucaugacccagaccccccucucccuccccgucucccucggcgaccaggccuccaucuccugcaccuccggccagucccucguccacaucaacggcaacaccuaccuccacugguaccuccagaagcccggccagucccccaagcuccucaucuacaaggucuccaaccucuucuccggcguccccgaccgcuucuccggcuccggcuccggcaccgacuucacccucaagaucucccgcgucgaggccgaggaccucggcgucuacuucugcucccaguccacccacuuccccuucaccuucggcaccggcaccaagcucgagaucaag

SEQ ID NO: 15824 - RNA, 366 nt, Artificial Sequence
  derived and/or modified sequence opt2 from Lpathomab_gamma1-Chain_VDJ-Region
cagguccagcuccagcaguccggcgccgagcucguccgccccggcaccuccgucaaggucuccugcaaggccuccggcuacggcuucaucaacuaccucaucgaguggaucaagcagcgccccggccagggccucgaguggaucggccucaucaaccccggcuccgacuacaccaacuacaacgagaacuucaagggcaaggccacccucaccgccgacaaguccuccuccaccgccuacaugcaccucuccucccucaccuccgaggacuccgccgucuacuucugcgcccgccgcuucggcuacuacggcuccggcaacuacuucgacuacuggggccagggcaccacccucaccgucuccucc

SEQ ID NO: 15825 - RNA, 1350 nt, Artificial Sequence
  derived and/or modified sequence opt2 from Lucatumumab_HeavyChain1
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgaggaguccaaccgcuaccacgccgacuccgucaagggccgcuucaccaucucccgcgacaacuccaagaucacccucuaccuccagaugaacucccuccgcaccgaggacaccgccgucuacuacugcgcccgcgacggcggcaucgccgcccccggccccgacuacuggggccagggcacccucgucaccgucuccuccgccuccaccaagggccccuccgucuucccccucgcccccgccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15826 - RNA, 657 nt, Artificial Sequence
  derived and/or modified sequence opt2 from Lucatumumab_LightChain1
gacaucgucaugacccaguccccccucucccucaccgucacccccggcgagcccgccuccaucuccugccgcuccucccagucccuccucuacuccaacggcuacaacuaccucgacugguaccuccagaagcccggccaguccccccagguccucaucucccucggcuccaaccgcgccuccggcguccccgaccgcuucuccggcuccggcuccggcaccgacuucacccucaagaucucccgcgucgaggccgaggacgucggcgucuacuacugcaugcaggcccgccagacccccuucaccuucggccccggcaccaaggucgacauccgccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15827 - RNA, 324 nt, Artificial Sequence
  derived and/or modified sequence opt2 from Lulizumab_pegol_LightChain1
gacauccagaugacccagucccccuccucccucuccgccuccgucggcgaccgcgucaccaucaccugccgcgccucccgccccaucuggcccuuccucgagugguaccagcagaagcccggcaaggcccccaagcuccucaucuacuucaccucccgccuccgccacggcguccccucccgcuucuccggcuccggcuccggcaccugcuucacccucaccaucuccucccuccagcccgaggacuucgccaccuacuacugccuccagaacgucgccaaccccgccaccuucucccagggcaccaaggucgagaucaagcgc

SEQ ID NO: 15828 - RNA, 324 nt, Artificial Sequence; identical to SEQ ID NO: 15827
  derived and/or modified sequence opt2 from Lulizumab_pegol_LightChain

SEQ ID NO: 15829 - RNA, 1194 nt, Artificial Sequence
  derived and/or modified sequence opt2 from Lumiliximab_HeavyChain1
gagguccagcucgucgaguccggcggcggccucgccaagcccggcggcucccuccgccucuccugcgccgccuccggcuuccgcuucaccuucaacaacuacuacauggacuggguccgccaggcccccggccagggccucgaguggguccucaccaccggcuccgacuccuggggccagggcguccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15830 - RNA, 642 nt, Artificial Sequence
  derived and/or modified sequence opt2 from Lumiliximab_LightChain1
gacauccagaugacccagucccccuccucccucuccgccuccgucggcgaccgcgucaccaucaccugccgcgccucccaggacauccgcuacuaccucaacugguaccagcagaagcccggcaaggcccccaagcuccucaucuacgucgccuccucccuccaguccggcguccccucccgcuucuccggcuccggcuccggcaccgaguucacccucaccgucuccucccuccagcccgaggacuucgccaccuacuacugccuccaggucuacuccaccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15831 - RNA, 1347 nt, Artificial Sequence
  derived and/or modified sequence opt2 from Lumretuzumab_HeavyChain1
cagguccagcucguccaguccggcgccgaggucaagaagcccggcgccuccgucaaggucuccugcaaggccuccggcuacaccuuccgcuccuccuacaucuccuggguccgccaggcccccggccagggccucgaguggaugggcuggaucuacgccggcaccggcucccccuccuacaaccagaagcuccagggccgcgucaccaugaccaccgacaccuccaccuccaccgccuacauggagcuccgcucccuccgcuccgacgacaccgccgucuacuacugcgcccgccaccgcgacuacuacuccaacucccucaccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15832 - RNA, 660 nt, Artificial Sequence
  derived and/or modified sequence opt2 from Lumretuzumab_LightChain1
gacaucgucaugacccagucccccgacucccucgccgucucccucggcgagcgcgccaccaucaacugcaaguccucccaguccguccucaacuccggcaaccagaagaacuaccucaccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccaguccgacuacuccuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15833 - RNA, 1329 nt, Artificial Sequence; identical to SEQ ID NO: 15359
  derived and/or modified sequence opt2 from Lutetium_(177Lu)_lilotomab_satetraxetan_HeavyChain1

SEQ ID NO: 15834 - RNA, 642 nt, Artificial Sequence; identical to SEQ ID NO: 15360
  derived and/or modified sequence opt2 from Lutetium_(177Lu)_lilotomab_satetraxetan_LightChain1

SEQ ID NO: 15835 - RNA, 1350 nt, Artificial Sequence
  derived and/or modified sequence opt2 from Margetuximab_HeavyChain1
cagguccagcuccagcaguccggccccgagcucgucaagcccggcgccucccucaagcucuccugcaccgccuccggcuucaacaucaaggacaccuacauccacugggucaagcagcgccccgagcagggccucgaguggaucggccgcaucuaccccaccaacggcuacacccgcuacgaccccaaguuccaggacaaggccaccaucaccgccgacaccuccuccaacaccgccuaccuccaggucucccgccucaccuccgaggacaccgccgucuacuacugcucccgcuggggcggcgacggcuucuacgccauggacuacuggggccagggcgccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcucgucggcggccccuccgucuuccuccucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccccgaggagcaguacaacuccacccuccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccucguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15836 - RNA, 642 nt, Artificial Sequence
  derived and/or modified sequence opt2 from Margetuximab_LightChain1
gacaucgucaugacccagucccacaaguucauguccaccuccgucggcgaccgcgucuccaucaccugcaaggccucccaggacgucaacaccgccgucgccugguaccagcagaagcccggccacucccccaagcuccucaucuacuccgccuccuuccgcuacaccggcguccccgaccgcuucaccggcucccgcuccggcaccgacuucaccuucaccaucuccuccguccaggccgaggaccucgccgucuacuacugccagcagcacuacaccaccccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15837 - RNA, 762 nt, Artificial Sequence
  derived and/or modified sequence opt2 from Marzeptacog_alfa_HeavyChain1
aucgucggcggcaaggucugccccaagggcgagugccccuggcagguccuccuccucgucaacggcgcccagcucugcggcggcacccucaucaacaccaucugggucgucuccgccgcccacugcuucgacaagaucaagaacuggcgcaaccucaucgccguccucggcgagcacgaccucuccgagcacgacggcgacgagcagucccgccgcgucgcccaggucaucauccccuccaccuacguccccggcaccaccaaccacgacaucgcccuccuccgccuccaccagcccgucguccucaccgaccacgucgucccccucugccuccccgagcgcaccuucuccgagcgcacccucgccuucguccgcuucucccucgucuccggcuggggccgccuccucgaccgcggcgccaccgcccucgagcuccagguccucaacgucccccgccucaugacccaggacugccuccagcagucccgcaaggucggcgacucccccaacaucaccgaguacauguucugcgccggcuacuccgacggcuccaaggacuccugcaagggcgacuccggcggcccccacgccacccacuaccgcggcaccugguaccucaccggcaucgucuccuggggccagggcugcgccaccgucggccacuucggcgucuacacccgcgucucccaguacaucgaguggcuccagaagcucaugcgcuccgagccccgccccggcguccuccuccgcgcccccuucccc

SEQ ID NO: 15838 - RNA, 456 nt, Artificial Sequence
  derived and/or modified sequence opt2 from Marzeptacog_alfa_LightChain1
gccaacgccuuccucgaggagcuccgccccggcucccucgagcgcgagugcaaggaggagcagugcuccuucgaggaggcccgcgagaucuucaaggacgccgagcgcaccaagcucuucuggaucuccuacuccgacggcgaccagugcgccuccucccccugccagaacggcggcuccugcaaggaccagcuccaguccuacaucugcuucugccuccccgccuucgagggccgcaacugcgagacccacaaggacgaccagcucaucugcgucaacgagaacggcggcugcgagcaguacugcuccgaccacaccggcaccaagcgcuccugccgcugccacgagggcuacucccuccucgccgacggcgucuccugcaacgccaccgucgaguaccccugcggcaagauccccauccucgagaagcgcaacgccuccaagccccagggccgc

SEQ ID NO: 15839 - RNA, 669 nt, Artificial Sequence
  derived and/or modified sequence opt2 from Matuzumab_HeavyChain1_variant_3c08_H
cagguccagcucguccaguccggcgccgaggucaagaagcccggcgccuccgucaaggucuccugcaaggccuccggcuacaccuucaccucccacuggaugcacuggguccgccaggcccccggccagggccucgaguggaucggcgaguucaaccccuccaacggccgcaccaacuacaacgagaaguucaaguccaaggccaccaugaccgucgacaccuccaccaacaccgccuacauggagcucuccucccuccgcuccgaggacaccgccgucuacuacugcgccucccgcgacuacgacuacgacggccgcuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaagucc

SEQ ID NO: 15840 - RNA, 669 nt, Artificial Sequence
  derived and/or modified sequence opt2 from Matuzumab_HeavyChain1_variant_3c09_C
cagguccagcucguccaguccggcgccgaggucaagaagcccggcgccuccgucaaggucuccugcaaggccuccggcuacaccuucaccucccacuggaugcacuggguccgccaggcccccggccagggccucgaguggaucggcgaguucaaccccuccaacggccgcaccaacuacaacgagaaguucaaguccaaggccaccaugaccgucgacaccuccaccaacaccgccuacauggagcucuccucccuccgcuccgaggacaccgccgucuacuacugcgccucccgcgacuacgacuacgccggccgcuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaagucc

SEQ ID NO: 15841 - RNA, 636 nt, Artificial Sequence
  derived and/or modified sequence opt2 from Matuzumab_LightChain1_variant_3c08_L
gacauccagaugacccagucccccuccucccucuccgccuccgucggcgaccgcgucaccaucaccugcuccgccuccuccuccgucaccuacauguacugguaccagcagaagcccggcaaggcccccaagcuccucaucuacgacaccuccaaccucgccuccggcguccccucccgcuucuccggcuccggcuccggcaccgacuacaccuucaccaucuccucccuccagcccgaggacaucgccaccuacuacugccagcagugguccucccacaucuucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgag

SEQ ID NO: 15842 - RNA, 636 nt, Artificial Sequence; identical to SEQ ID NO: 15841
  derived and/or modified sequence opt2 from Matuzumab_LightChain1_variant_3c09_B

SEQ ID NO: 15843 - RNA, 1341 nt, Artificial Sequence
  derived and/or modified sequence opt2 from Mavrilimumab_HeavyChain1
cagguccagcucguccaguccggcgccgaggucaagaagcccggcgccuccgucaaggucuccugcaaggucuccggcuacacccucaccgagcucuccauccacuggguccgccaggcccccggcaagggccucgaguggaugggcggcuucgaccccgaggagaacgagaucgucuacgcccagcgcuuccagggccgcgucaccaugaccgaggacaccuccaccgacaccgccuacauggagcucuccucccuccgcuccgaggacaccgccgucuacuacugcgccaucgucggcuccuucuccccccucacccucggccucuggggccagggcaccauggucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15844 - RNA, 651 nt, Artificial Sequence
  derived and/or modified sequence opt2 from Mavrilimumab_LightChain1
caguccguccucacccagccccccuccgucuccggcgcccccggccagcgcgucaccaucuccugcaccggcuccggcuccaacaucggcgcccccuacgacgucuccugguaccagcagcuccccggcaccgcccccaagcuccucaucuaccacaacaacaagcgccccuccggcguccccgaccgcuucuccggcuccaaguccggcaccuccgccucccucgccaucaccggccuccaggccgaggacgaggccgacuacuacugcgccaccgucgaggccggccucuccggcuccgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15845 - RNA, 1359 nt, Artificial Sequence
  derived and/or modified sequence opt2 from MDX-1303_HeavyChain1
cagguccagcucgucgaguccggcggcggcgucguccagcccggccgcucccuccgccucuccugcgccgccuccggcuucaccuucuccuacuacggcaugcacuggguccgccaggcccccggcaagggccucgagugggucgccgucaucuggcacgacgaguccaucgucuacuacgccgacuccgucaagggccgcuucaccaucucccgcgacaacuccaagaacacccucuaccuccagaugaacucccuccgcgccgaggacaccgccgucuacuacugcacccgcgaccccggcgaccccuacuacuacuacuacggccucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15846 - RNA, 645 nt, Artificial Sequence
  derived and/or modified sequence opt2 from MDX-1303_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15847 - RNA, 1347 nt, Artificial Sequence
  derived and/or modified sequence opt2 from Mepolizumab_HeavyChain1
caggucacccuccgcgaguccggccccgcccucgucaagcccacccagacccucacccucaccugcaccgucuccggcuucucccucaccuccuacuccguccacuggguccgccagccccccggcaagggccucgaguggcucggcgucaucugggccuccggcggcaccgacuacaacuccgcccucaugucccgccucuccaucuccaaggacaccucccgcaaccaggucguccucaccaugaccaacauggaccccgucgacaccgccaccuacuacugcgcccgcgacccccccuccucccuccuccgccucgacuacuggggccgcggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15848 - RNA, 660 nt, Artificial Sequence
  derived and/or modified sequence opt2 from Mepolizumab_LightChain1
gacaucgucaugacccagucccccgacucccucgccgucucccucggcgagcgcgccaccaucaacugcaaguccucccagucccuccucaacuccggcaaccagaagaacuaccucgccugguaccagcagaagcccggccagccccccaagcuccucaucuacggcgccuccacccgcgaguccggcguccccgaccgcuucuccggcuccggcuccggcaccgacuucacccucaccaucuccucccuccaggccgaggacgucgccgucuacuacugccagaacguccacuccuuccccuucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15849 - RNA, 1350 nt, Artificial Sequence
  derived and/or modified sequence opt2 from Metelimumab_HeavyChain1
gagguccagcucgucgaguccggcggcggcgucguccagcccggccgcucccuccgccucuccugcgccgccuccggcuucaccuucuccuccuacggcaugcacuggguccgccaggcccccggcaaggagcucgagugggucgccgucaucuccuacgacggcuccaucaaguacuacgccgacuccgucaagggccgcuucaccaucucccgcgacaacuccaagaacacccucuaccuccagaugaacucccuccgcgccgaggacaccgccgucuacuacugcgcccgcaccggcgaguacuccggcuacgacaccgacccccaguacuccuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaagcccacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15850 - RNA, 639 nt, Artificial Sequence
  derived and/or modified sequence opt2 from Metelimumab_LightChain1
gagaucguccucacccagucccccuccucccucuccgccuccgucggcgaccgcgucaccaucaccugccgcgccucccagggcaucggcgacgaccucggcugguaccagcagaagcccggcaaggcccccauccuccucaucuacggcaccuccacccuccaguccggcguccccucccgcuucuccggcuccggcuccggcaccgacuucacccucaccaucaacucccuccagcccgaggacuucgccaccuacuacugccuccaggacuccaacuacccccucaccuucggcggcggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucucccccgucaccaaguccuucaaccgcggcgagugc

SEQ ID NO: 15851 - RNA, 1350 nt, Artificial Sequence
  derived and/or modified sequence opt2 from Milatuzumab_HeavyChain1
cagguccagcuccagcaguccggcuccgagcucaagaagcccggcgccuccgucaaggucuccugcaaggccuccggcuacaccuucaccaacuacggcgucaacuggaucaagcaggcccccggccagggccuccaguggaugggcuggaucaaccccaacaccggcgagcccaccuucgacgacgacuucaagggccgcuucgccuucucccucgacaccuccgucuccaccgccuaccuccagaucuccucccucaaggccgacgacaccgccgucuacuucugcucccgcucccgcggcaagaacgaggccugguucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15852 - RNA, 657 nt, Artificial Sequence
  derived and/or modified sequence opt2 from Milatuzumab_LightChain1
gacauccagcucacccaguccccccucucccuccccgucacccucggccagcccgccuccaucuccugccgcuccucccagucccucguccaccgcaacggcaacaccuaccuccacugguuccagcagcgccccggccaguccccccgccuccucaucuacaccgucuccaaccgcuucuccggcguccccgaccgcuucuccggcuccggcuccggcaccgacuucacccucaagaucucccgcgucgaggccgaggacgucggcgucuacuucugcucccaguccucccacgucccccccaccuucggcgccggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15853 - RNA, 1341 nt, Artificial Sequence
  derived and/or modified sequence opt2 from Mirvetuximab_HeavyChain1
cagguccagcucguccaguccggcgccgaggucgucaagcccggcgccuccgucaagaucuccugcaaggccuccggcuacaccuucaccggcuacuucaugaacugggucaagcagucccccggccagucccucgaguggaucggccgcauccaccccuacgacggcgacaccuucuacaaccagaaguuccagggcaaggccacccucaccgucgacaaguccuccaacaccgcccacauggagcuccucucccucaccuccgaggacuucgccgucuacuacugcacccgcuacgacggcucccgcgccauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15854 - RNA, 654 nt, Artificial Sequence
  derived and/or modified sequence opt2 from Mirvetuximab_LightChain1
gacaucguccucacccaguccccccucucccucgccgucucccucggccagcccgccaucaucuccugcaaggccucccaguccgucuccuucgccggcaccucccucaugcacugguaccaccagaagcccggccagcagccccgccuccucaucuaccgcgccuccaaccucgaggccggcguccccgaccgcuucuccggcuccggcuccaagaccgacuucacccucaccaucucccccgucgaggccgaggacgccgccaccuacuacugccagcagucccgcgaguaccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15855 - RNA, 1344 nt, Artificial Sequence
  derived and/or modified sequence opt2 from Modotuximab_HeavyChain1
cagguccagcuccagcagcccggcgccgagcucgucgagcccggcggcuccgucaagcucuccugcaaggccuccggcuacaccuucaccucccacuggaugcacugggucaagcagcgccccggccagggccucgaguggaucggcgagaucaaccccuccuccggccgcaacaacuacaacgagaaguucaaguccaaggccacccucaccgucgacaaguccuccuccaccgccuacaugcaguucuccucccucaccuccgaggacuccgccgucuacuacugcguccgcuacuacggcuacgacgaggccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15856 - RNA, 657 nt, Artificial Sequence
  derived and/or modified sequence opt2 from Modotuximab_LightChain1
gacaucgucaugacccaggccgccuucuccaaccccgucacccucggcaccuccgccuccaucuccugccgcuccuccaagucccuccuccacuccaacggcaucaccuaccucuacugguaccuccagaagcccggccaguccccccagcuccucaucuaccagauguccaaccucgccuccggcguccccgaccgcuucuccuccuccggcuccggcaccgacuucacccuccgcaucucccgcgucgaggccgaggacgucggcgucuacuacugcgcccagaaccucgagcuccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15857 - RNA, 1347 nt, Artificial Sequence
  derived and/or modified sequence opt2 from Mogamulizumab_HeavyChain1
gagguccagcucgucgaguccggcggcgaccucguccagcccggccgcucccuccgccucuccugcgccgccuccggcuucaucuucuccaacuacggcauguccuggguccgccaggcccccggcaagggccucgagugggucgccaccaucuccuccgccuccaccuacuccuacuaccccgacuccgucaagggccgcuucaccaucucccgcgacaacgccaagaacucccucuaccuccagaugaacucccuccgcgucgaggacaccgcccucuacuacugcggccgccacuccgacggcaacuucgccuucggcuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15858 - RNA, 657 nt, Artificial Sequence
  derived and/or modified sequence opt2 from Mogamulizumab_LightChain1
gacguccucaugacccaguccccccucucccuccccgucacccccggcgagcccgccuccaucuccugccgcuccucccgcaacaucguccacaucaacggcgacaccuaccucgagugguaccuccagaagcccggccaguccccccagcuccucaucuacaaggucuccaaccgcuucuccggcguccccgaccgcuucuccggcuccggcuccggcaccgacuucacccucaagaucucccgcgucgaggccgaggacgucggcgucuacuacugcuuccagggcucccuccuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15859 - RNA, 1356 nt, Artificial Sequence
  derived and/or modified sequence opt2 from Monalizumab_HeavyChain1
cagguccagcucguccaguccggcgccgaggucaagaagcccggcgccuccgucaaggucuccugcaaggccuccggcuacaccuucaccuccuacuggaugaacuggguccgccaggcccccggccagggccucgaguggaugggccgcaucgaccccuacgacuccgagacccacuacgcccagaagcuccagggccgcgucaccaugaccaccgacaccuccaccuccaccgccuacauggagcuccgcucccuccgcuccgacgacaccgccgucuacuacugcgcccgcggcggcuacgacuucgacgucggcacccucuacugguucuucgacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15860 - RNA, 642 nt, Artificial Sequence
  derived and/or modified sequence opt2 from Monalizumab_LightChain1
gacauccagaugacccagucccccuccucccucuccgccuccgucggcgaccgcgucaccaucaccugccgcgccuccgagaacaucuacuccuaccucgccugguaccagcagaagcccggcaaggcccccaagcuccucaucuacaacgccaagacccucgccgagggcguccccucccgcuucuccggcuccggcuccggcaccgacuucacccucaccaucuccucccuccagcccgaggacuucgccaccuacuacugccagcaccacuacggcaccccccgcaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15861 - RNA, 1350 nt, Artificial Sequence
  derived and/or modified sequence opt2 from Motavizumab_HeavyChain
caggucacccuccgcgaguccggccccgcccucgucaagcccacccagacccucacccucaccugcaccuucuccggcuucucccucuccaccgccggcauguccgucggcuggauccgccagccccccggcaaggcccucgaguggcucgccgacaucuggugggacgacaagaagcacuacaaccccucccucaaggaccgccucaccaucuccaaggacaccuccaagaaccaggucguccucaaggucaccaacauggaccccgccgacaccgccaccuacuacugcgcccgcgacaugaucuucaacuucuacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15862 - RNA, 1350 nt, Artificial Sequence; identical to SEQ ID NO: 15861
  derived and/or modified sequence opt2 from Motavizumab_HeavyChain_variant

SEQ ID NO: 15863 - RNA, 639 nt, Artificial Sequence
  derived and/or modified sequence opt2 from Motavizumab_LightChain
gacauccagaugacccagucccccuccacccucuccgccuccgucggcgaccgcgucaccaucaccugcuccgccuccucccgcgucggcuacaugcacugguaccagcagaagcccggcaaggcccccaagcuccucaucuacgacaccuccaagcucgccuccggcguccccucccgcuucuccggcuccggcuccggcaccgaguucacccucaccaucuccucccuccagcccgacgacuucgccaccuacuacugcuuccagggcuccggcuaccccuucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15864 - RNA, 639 nt, Artificial Sequence; identical to SEQ ID NO: 15863
  derived and/or modified sequence opt2 from Motavizumab_LightChain_variant

SEQ ID NO: 15865 - RNA, 1428 nt, Artificial Sequence
  derived and/or modified sequence opt2 from Moxetumomab_pasudotox_HeavyChain1
auggagguccagcucgucgaguccggcggcggccucgucaagcccggcggcucccucaagcucuccugcgccgccuccggcuucgccuucuccaucuacgacauguccuggguccgccagacccccgagaagugccucgagugggucgccuacaucuccuccggcggcggcaccaccuacuaccccgacaccgucaagggccgcuucaccaucucccgcgacaacgccaagaacacccucuaccuccagauguccucccucaaguccgaggacaccgccauguacuacugcgcccgccacuccggcuacggcacccacuggggcguccucuucgccuacuggggccagggcacccucgucaccgucuccgccaaggccuccggcggccccgagggcggcucccucgccgcccucaccgcccaccaggccugccaccucccccucgagaccuucacccgccaccgccagccccgcggcugggagcagcucgagcagugcggcuaccccguccagcgccucgucgcccucuaccucgccgcccgccucuccuggaaccaggucgaccaggucauccgcaacgcccucgccucccccggcuccggcggcgaccucggcgaggccauccgcgagcagcccgagcaggcccgccucgcccucacccucgccgccgccgaguccgagcgcuucguccgccagggcaccggcaacgacgaggccggcgccgccaacggccccgccgacuccggcgacgcccuccucgagcgcaacuaccccaccggcgccgaguuccucggcgacggcggcgacgucuccuucuccacccgcggcacccagaacuggaccgucgagcgccuccuccaggcccaccgccagcucgaggagcgcggcuacgucuucgucggcuaccacggcaccuuccucgaggccgcccaguccaucgucuucggcggcguccgcgcccgcucccaggaccucgacgccaucuggcgcggcuucuacaucgccggcgaccccgcccucgccuacggcuacgcccaggaccaggagcccgacgcccgcggccgcauccgcaacggcgcccuccuccgcgucuacgucccccgcuccucccuccccggcuucuaccgcaccucccucacccucgccgcccccgaggccgccggcgaggucgagcgccucaucggccacccccucccccuccgccucgacgccaucaccggccccgaggaggagggcggccgccucgagaccauccucggcuggccccucgccgagcgcaccgucgucauccccuccgccauccccaccgacccccgcaacgucggcggcgaccucgaccccuccuccauccccgacaaggagcaggccaucuccgcccuccccgacuacgccucccagcccggcaagcccccccgcgaggaccucaag

SEQ ID NO: 15866 - RNA, 324 nt, Artificial Sequence
  derived and/or modified sequence opt2 from Moxetumomab_pasudotox_LightChain1
auggacauccagaugacccagaccaccuccucccucuccgccucccucggcgaccgcgucaccaucuccugccgcgccucccaggacaucuccaacuaccucaacugguaccagcagaagcccgacggcaccgucaagcuccucaucuacuacaccuccauccuccacuccggcguccccucccgcuucuccggcuccggcuccggcaccgacuacucccucaccaucuccaaccucgagcaggaggacuucgccaccuacuucugccagcagggcaacacccuccccuggaccuucggcugcggcaccaagcucgagaucaag

SEQ ID NO: 15867 - RNA, 1350 nt, Artificial Sequence
  derived and/or modified sequence opt2 from Muromonab-CD3_HeavyChain
cagguccagcuccagcaguccggcgccgagcucgcccgccccggcgccuccgucaagauguccugcaaggccuccggcuacaccuucacccgcuacaccaugcacugggucaagcagcgccccggccagggccucgaguggaucggcuacaucaaccccucccgcggcuacaccaacuacaaccagaaguucaaggacaaggccacccucaccaccgacaaguccuccuccaccgccuacaugcagcucuccucccucaccuccgaggacuccgccgucuacuacugcgcccgcuacuacgacgaccacuacugccucgacuacuggggccagggcaccacccucaccgucuccuccgccaagaccaccgcccccuccgucuacccccucgcccccgucugcggcggcaccaccggcuccuccgucacccucggcugccucgucaagggcuacuuccccgagcccgucacccucaccuggaacuccggcucccucuccuccggcguccacaccuuccccgccguccuccaguccgaccucuacacccucuccuccuccgucaccgucaccuccuccaccuggcccucccaguccaucaccugcaacgucgcccaccccgccuccuccaccaaggucgacaagaagaucgagccccgccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15868 - RNA, 639 nt, Artificial Sequence
  derived and/or modified sequence opt2 from Muromonab-CD3_LightChain
cagaucguccucacccagucccccgccaucauguccgccucccccggcgagaaggucaccaugaccugcuccgccuccuccuccgucuccuacaugaacugguaccagcagaaguccggcaccucccccaagcgcuggaucuacgacaccuccaagcucgccuccggcguccccgcccacuuccgcggcuccggcuccggcaccuccuacucccucaccaucuccggcauggaggccgaggacgccgccaccuacuacugccagcagugguccuccaaccccuucaccuucggcuccggcaccaagcucgagaucaaccgcgccgacaccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15869 - RNA, 1347 nt, Artificial Sequence
  derived and/or modified sequence opt2 from Namilumab_HeavyChain1
cagguccagcucguccaguccggcgccgaggucaagaagcccggcgccuccgucaaggucuccugcaaggccuucggcuaccccuucaccgacuaccuccuccacuggguccgccaggcccccggccagggccucgagugggucggcuggcucaaccccuacuccggcgacaccaacuacgcccagaaguuccagggccgcgucaccaugacccgcgacaccuccaucuccaccgccuacauggagcucucccgccuccgcuccgacgacaccgccgucuacuacugcacccgcaccacccucaucuccgucuacuucgacuacuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15870 - RNA, 642 nt, Artificial Sequence
  derived and/or modified sequence opt2 from Namilumab_LightChain1
gacauccagaugacccagucccccuccuccgucuccgccuccgucggcgaccgcgucaccaucgccugccgcgccucccagaacauccgcaacauccucaacugguaccagcagcgccccggcaaggccccccagcuccucaucuacgccgccuccaaccuccaguccggcguccccucccgcuucuccggcuccggcuccggcaccgacuucacccucaccaucaacucccuccagcccgaggacuucgccaccuacuacugccagcaguccuacuccaugccccgcaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15871 - RNA, 1374 nt, Artificial Sequence
  derived and/or modified sequence opt2 from Naptumomab_estafenatox_HeavyChain
gagguccagcuccagcaguccggccccgaccucgucaagcccggcgccuccgucaagaucuccugcaaggccuccggcuacuccuucaccggcuacuacaugcacugggucaagcagucccccggcaagggccucgaguggaucggccgcaucaaccccaacaacggcgucacccucuacaaccagaaguucaaggacaaggccacccucaccgucgacaaguccuccaccaccgccuacauggagcuccgcucccucaccuccgaggacuccgccgucuacuacugcgcccgcuccaccaugaucaccaacuacgucauggacuacuggggccagggcaccuccgucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccaccuggcccuccgagaccgucaccugcaacgucgcccaccccgccuccuccaccaaggucgacaagaagaucgucccccgcgacuccggcggccccuccgagaaguccgaggagaucaacgagaaggaccuccgcaagaaguccgagcuccagggcaccgcccucggcaaccucaagcagaucuacuacuacaacuccaaggccaucaccuccuccgagaaguccgccgaccaguuccucaccaacacccuccucuucaagggcuucuucaccggccaccccugguacaacgaccuccucgucgaccucggcuccaccgccgccaccuccgaguacgagggcuccuccgucgaccucuacggcgccuacuacggcuaccagugcgccggcggcacccccaacaagaccgccugcauguacggcggcgucacccuccacgacaacaaccgccucaccgaggagaagaagguccccaucaaccucuggaucgacggcaagcagaccaccguccccaucgacaaggucaagaccuccaagaaggaggucaccguccaggagcucgaccuccaggcccgccacuaccuccacggcaaguucggccucuacaacuccgacuccuucggcggcaagguccagcgcggccucaucgucuuccacuccuccgagggcuccaccgucuccuacgaccucuucgacgcccagggccaguaccccgacacccuccuccgcaucuaccgcgacaacaccaccaucuccuccaccucccucuccaucucccucuaccucuacaccacc

SEQ ID NO: 15872 - RNA, 642 nt, Artificial Sequence
  derived and/or modified sequence opt2 from Naptumomab_estafenatox_LightChain
uccaucgucaugacccagacccccaccucccuccucgucuccgccggcgaccgcgucaccaucaccugcaaggccucccaguccgucuccaacgacgucgccugguaccagcagaagcccggccagucccccaagcuccucaucuccuacaccuccucccgcuacgccggcguccccgaccgcuucuccggcuccggcuacggcaccgacuucacccucaccaucuccuccguccaggccgaggacgccgccgucuacuucugccagcaggacuacaacuccccccccaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagucc

SEQ ID NO: 15873 - RNA, 1356 nt, Artificial Sequence
  derived and/or modified sequence opt2 from Narnatumab_HeavyChain1
gagguccagcucgucgaguccggcggcggccucguccagcccggcggcucccuccgccucuccugcgccgccuccggcuucaccuucuccuccuaccucaugaccuggguccgccaggcccccggcaagggccucgagugggucgccaacaucaagcaggacggcuccgagaaguacuacgucgacuccgucaagggccgcuucaccaucucccgcgacaacgccaagaacucccucaaccuccagaugaacucccuccgcgccgaggacaccgccgucuacuacugcacccgcgacggcuacuccuccggccgccacuacggcauggacgucuggggccagggcaccaccgucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15874 - RNA, 642 nt, Artificial Sequence
  derived and/or modified sequence opt2 from Narnatumab_LightChain1
gagaucguccucacccagucccccgccacccucucccucucccccggcgagcgcgccacccucuccugccgcgccucccaguccgucucccgcuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15875 - RNA, 1350 nt, Artificial Sequence
  derived and/or modified sequence opt2 from Natalizumab_HeavyChain1
cagguccagcucguccaguccggcgccgaggucaagaagcccggcgccuccgucaaggucuccugcaaggccuccggcuucaacaucaaggacaccuacauccacuggguccgccaggcccccggccagcgccucgaguggaugggccgcaucgaccccgccaacggcuacaccaaguacgaccccaaguuccagggccgcgucaccaucaccgccgacaccuccgccuccaccgccuacauggagcucuccucccuccgcuccgaggacaccgccgucuacuacugcgcccgcgagggcuacuacggcaacuacggcgucuacgccauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15876 - RNA, 639 nt, Artificial Sequence
  derived and/or modified sequence opt2 from Natalizumab_LightChain1
gacauccagaugacccagucccccuccucccucuccgccuccgucggcgaccgcgucaccaucaccugcaagaccucccaggacaucaacaaguacauggccugguaccagcagacccccggcaaggccccccgccuccucauccacuacaccuccgcccuccagcccggcauccccucccgcuucuccggcuccggcuccggccgcgacuacaccuucaccaucuccucccuccagcccgaggacaucgccaccuacuacugccuccaguacgacaaccucuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15877 - RNA, 1335 nt, Artificial Sequence
  derived and/or modified sequence opt2 from Navicixizumab_HeavyChain1
cagguccagcucguccaguccggcgccgaggucaagaagcccggcgccuccgucaagaucuccugcaaggccuccggcuacuccuucaccgccuacuacauccacugggucaagcaggcccccggccagggccucgaguggaucggcuacaucuccaacuacaaccgcgccaccaacuacaaccagaaguucaagggccgcgucaccuucaccaccgacaccuccaccuccaccgccuacauggagcuccgcucccuccgcuccgacgacaccgccgucuacuacugcgcccgcgacuacgacuacgacgucggcauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucgagggcuucuaccccuccgacaucgccgucgagugggaguccaacggccagcccgagaacaacuacaagaccaccccccccaugcucgacuccgacggcuccuucuuccucuacuccgagcucaccgucgacaagucccgcuggcagcagggcaacgucuucuccugcuccgucaugcacgaggcccuccacaaccacuacacccagaagucccucucccucucccccggcaag

SEQ ID NO: 15878 - RNA, 1341 nt, Artificial Sequence
  derived and/or modified sequence opt2 from Navicixizumab_HeavyChain2
cagguccagcucguccaguccggcgccgaggucaagaagcccggcgccuccgucaaggucuccugcaaggccuccggcuacaccuucaccaacuacuggaugcacuggguccgccaggcccccggccagggccucgaguggaugggcgacaucaaccccuccaacggccgcaccuccuacaaggagaaguucaagcgccgcgucacccucuccgucgacaaguccuccuccaccgccuacauggagcucuccucccuccgcuccgaggacaccgccgucuacuucugcaccauccacuacgacgacaaguacuacccccucauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgagaagaugaccaagaaccaggucucccucaccugccucgucaagggcuucuaccccuccgacaucgccgucgagugggaguccaacggccagcccgagaacaacuacaagaccaccccccccaugcucaaguccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15879 - RNA, 654 nt, Artificial Sequence; identical to SEQ ID NO: 15483
  derived and/or modified sequence opt2 from Navicixizumab_LightChain1

SEQ ID NO: 15880 - RNA, 1368 nt, Artificial Sequence
  derived and/or modified sequence opt2 from Navivumab_HeavyChain1
cagguccagcucguccaguccggcgccgaggucaagaagcccggcgccuccgucaaggucuccugcaagaccuccggcuacuccuucuccaccuacggcgucuccuggguccgccaggcccccggccagggccccgagugggucggcuggaucuccgccuacaccggcaucaccgacuacgcccagaaguuccagggccgcgucacccucaccaccgacgccaccaccgccaccgccuuccucgaccuccgcucccuccgccccgacgacaccgccaccuacuucugcgcccgcgacaagguccagggccgcgucgaggucggcuccggcggccgccacgacuacuggggccagggcacccucgucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 15881 - RNA, 645 nt, Artificial Sequence
  derived and/or modified sequence opt2 from Navivumab_LightChain1
gaggucguccucacccagucccccggcacccucgcccucccccccggcgagcgcgccacccucuccugccgcgccucccaccgcgucggcuccaccuacaucgccugguaccagcagaaguccggccaggccccccgccgccucaucuacggcgccuccaaccgcgccaccgacauccccgaccgcuucuccggcuccggcuccggcaccgacuucacccucaccauccgccgccucgagcccgaggacuccgccgucuacuacugccagcaguucuccgucucccccuggaccuucggccagggcacccgcgucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15882 - RNA, 2172 nt, Artificial Sequence
  derived and/or modified sequence opt2 from Ndimab-varB_HeavyChain
cagguccagcucgucgaguccggcggcggcgucguccagcccggccgcucccuccgccucuccugcgccgccuccggcuucaucuucuccuccuacgccaugcacuggguccgccaggcccccggcaacggccucgagugggucgccuucauguccuacgacggcuccaacaagaaguacgccgacuccgucaagggccgcuucaccaucucccgcgacaacuccaagaacacccucuaccuccagaugaacucccuccgcgccgaggacaccgccgucuacuacugcgcccgcgaccgcggcaucuccgccggcggcaacuacuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagggcggcggcggcuccggcggcggcggcucccagguccagcucguccaguccggcgccgaggucaagaagcccggcuccuccgucaaggucuccugcaaggccuccggcggcaccuucuccaccuacggcaucuccuggguccgccaggcccccggccagugccucgaguggaugggcggcaucauccccaucuucgacaccggcaacuccgcccaguccuuccagggccgcgucaccaucaccgccgacgaguccaccuccaccgccuacauggagcucuccucccuccgcuccgaggacaccgccgucuacuacugcgcccgcuccucccgcaucuacgaccucaaccccucccucaccgccuacuacgacauggacgucuggggccagggcaccauggucaccgucuccuccggcggcggcggcuccggcggcggcggcuccggcggcggcggcuccggcggcggcggcucccaguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccugggucuucggcugcggcaccaagcucaccguccuc

SEQ ID NO: 15883 - RNA, 645 nt, Artificial Sequence
  derived and/or modified sequence opt2 from Ndimab-varB_LightChain
gagaucguccucacccagucccccgccacccucucccucucccccggcgagcgcgccacccucuccugccgcgccucccaguccgucuacuccuaccucgccugguaccagcagaagcccggccaggccccccgccuccucaucuacgacgccuccaaccgcgccaucggcauccccgcccgcuucuccggcuccggcuccggcaccgacuucacccucaccaucuccucccucgagcccgaggacuucgccgucuacuacugccagcagcgcuccaacuggccccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15884 - RNA, 1353 nt, Artificial Sequence
  derived and/or modified sequence opt2 from Necitumumab_HeavyChain1
cagguccagcuccaggaguccggccccggccucgucaagcccucccagacccucucccucaccugcaccgucuccggcggcuccaucuccuccggcgacuacuacugguccuggauccgccagccccccggcaagggccucgaguggaucggcuacaucuacuacuccggcuccaccgacuacaaccccucccucaagucccgcgucaccauguccgucgacaccuccaagaaccaguucucccucaaggucaacuccgucaccgccgccgacaccgccgucuacuacugcgcccgcgucuccaucuucggcgucggcaccuucgacuacuggggccagggcacccucgucaccgucuccuccgccuccaccaagggccccuccguccucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15885 - RNA, 642 nt, Artificial Sequence
  derived and/or modified sequence opt2 from Necitumumab_LightChain1
gagaucgucaugacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccaccaguacggcuccaccccccucaccuucggcggcggcaccaaggccgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15886 - RNA, 396 nt, Artificial Sequence
  derived and/or modified sequence opt2 from Neliximab_HeavyChain_VH-Region
gagguccagcuccagcaguccggccccgagcucgucaagcccggcgccuccgucaagauguccugcaaggccuccggcuacaccuucaccaccuacgucaugcacugggucaagcagaagcccggccagggccucgaguggaucggcuacaucaaccccuacaacgacggcaccaacuacaacgagaaguucaagggcaaggccacccucaccuccgacaaguccuccuccaccgccuacauggagcucuccacccucaccuccgaggacuccgccgucuacuacugcgccgaguucaucaccaagaccgucggcggcuccaacugguaccucgacgucuggggcgccggcaccaccgucaccgucuccuccgccaagaccaccccccccaagcuc

SEQ ID NO: 15887 - RNA, 372 nt, Artificial Sequence
  derived and/or modified sequence opt2 from Neliximab_HeavyChain_VH-Region_variant1
cagguccagcucaagcaguccggccccgagcucgucaagcccggcgccuccgucaagauguccugcaaggccuccggcuacaccuucaccaccuacgucaugcacugggucaagcagaagcccggccagggccucgaguggaucggcuacaucaaccccuacaacgacggcaccaacuacaacgagaaguucaagggcaaggccacccucaccuccgacaaguccuccuccaccgccuacauggagcucuccacccucaccuccgaggacuccgccgucuacuacugcgccgaguucaucaccaagaccgucggcggcuccaacugguaccucgacgucuggggcgccggcaccaccgucaccgucuccucc

SEQ ID NO: 15888 - RNA, 318 nt, Artificial Sequence
  derived and/or modified sequence opt2 from Neliximab_LightChain_VL-Region
gacaucguccucacccagucccccgccaucauguccgccucccccggcgagaaggucaccaugaccugcuccgccuccuccuccaucuccuacauccacugguuccagcagaagcccggcaccucccccaagcgcuggaucuacgacaccuccaagcuccccuccggcguccccgcccgcuucuccggcuccggcuccggcaccuccuacucccucaccaucuccuccauggaggccgaggacgccgccaccuacuacugccaccagcgcuccuccuacaccuggaccuucggcggcggcaccaagcucgagaucaag

SEQ ID NO: 15889 - RNA, 354 nt, Artificial Sequence
  derived and/or modified sequence opt2 from Neliximab_LightChain_VL-Region_variant1
cagaucguccucacccagucccccgccaucauguccgccucccccggcgagaaggucaccaugaccugcuccgccuccuccuccaucuccuacauccacugguuccagcagaagcccggcaccucccccaagcgcuggaucuacgacaccuccaagcuccccuccggcguccccgcccgcuucuccggcuccggcuccggcaccuccuacucccucaccaucuccuccauggaggccgaggacgccgccaccuacuacugccaccagcgcuccuccuacaccuggaccuucggcggcggcaccaagcucgagaucaagcgcgccgacgccgcccccaccgucuccgccgccgcc

SEQ ID NO: 15890 - RNA, 1335 nt, Artificial Sequence
  derived and/or modified sequence opt2 from Nemolizumab_HeavyChain1
cagguccagcucguccaguccggcgccgaggucaagaagcccggcgccuccgucaaggucuccugcaaggccuccggcuacaccuucaccggcuacaucaugaacuggguccgccaggcccccggccagggccucgaguggaugggccucaucaaccccuacaacggcggcaccgacuacaacccccaguuccaggaccgcgucaccaucaccgccgacaaguccaccuccaccgccuacauggagcucuccucccuccgcuccgaggacaccgccgucuacuacugcgcccgcgacggcuacgacgacggccccuacacccucgagaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaaguccugcgucgagugcccccccugccccgccccccccgucgccggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcaggagggcaacgucuucuccugcuccgucaugcacgaggcccuccacaaccacuacacccagaagucccucucccucuccccc

SEQ ID NO: 15891 - RNA, 642 nt, Artificial Sequence
  derived and/or modified sequence opt2 from Nemolizumab_LightChain1
gacauccagaugacccagucccccuccucccucuccgccuccgucggcgaccgcgucaccaucaccugccaggccuccgaggacaucuacuccuucgucgccugguaccagcagaagcccggcaaggcccccaagcuccucaucuacaacgcccagaccgaggcccagggcguccccucccgcuucuccggcuccggcuccggcaccgacuucacccucaccaucuccucccuccagcccgaggacuucgccaccuacuacugccagcaccacuacgacuccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15892 - RNA, 1356 nt, Artificial Sequence
  derived and/or modified sequence opt2 from Nesvacumab_HeavyChain1
gagguccagcucgucgaguccggcggcggccucguccagcccggcggcucccuccgccucuccugcgccgccuccggcuucaccuucuccuccuacgacauccacuggguccgccaggccaccggcaagggccucgagugggucuccgccaucggccccgccggcgacaccuacuaccccggcuccgucaagggccgcuucaccaucucccgcgagaacgccaagaacucccucuaccuccagaugaacucccuccgcgccggcgacaccgccgucuacuacugcgcccgcggccucaucaccuucggcggccucaucgcccccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15893 - RNA, 642 nt, Artificial Sequence
  derived and/or modified sequence opt2 from Nesvacumab_LightChain1
gagaucguccucacccagucccccggcacccucucccucucccccggcgagcgcgccacccucuccugccgcgccucccaguccgucuccuccaccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcacuacgacaacucccagaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15894 - RNA, 1362 nt, Artificial Sequence
  derived and/or modified sequence opt2 from Neuradiab_HeavyChain1
gagguccagcuccagcaguccggccccgagcucgucaagcccggcgccuccgucaagauguccugcaaggccuccggcuacaccuucaccuccuacgucguccacugggucaagcagaaccccggccagggccucgaguggaucggcuacaucaaccccuucaacgacggcaccaaguacaacgagaacuucaagugcaaggccacccucaccuccgaccgcuccuccuccaccgccuacauggagcucuccucccucaccuccgaggaguccgccgucuacuucugcgcccgcgacaugggccgcgagggcuucgccuacuggggccagggcacccucgucaccgucuccgccgccaagaccaccccccccuccgucuacccccucgcccccggcugcggcgacaccaccggcuccuccgucacccucggcugccucgucaagggcuacuuccccgaguccgucaccgucaccuggaacuccggcucccucuccuccuccguccacaccuuccccgcccuccuccaguccggccucuacaccauguccuccuccgucaccguccccuccuccaccuggcccucccagaucgucaucugcuccgucgcccaccccgccuccuccaccaccgucgacaagaagcucgagcccuccggccccaucuccaccaucaaccccugcccccccugcaaggagugccacaagugccccgcccccaaccucgagggcggccccuccgucuucaucuucccccccaacaucaaggacguccucaugaucucccucacccccaaggucaccugcgucgucgucgacgucuccgaggacgaccccgacguccagaucuccugguucgucaacaacgucgagguccacaccgcccagacccagacccaccgcgaggacuacaacuccaccauccgcgucgucuccacccuccccauccagcaccaggacuggauguccggcaaggaguucaagugcaaggucaacaacaaggaccuccccucccccaucgagcgcaccaucuccaagaucaagggccucguccgcgccccccaggucuacauccuccccccccccgccgagcagcucucccgcaaggacgucucccucaccugccucgucgucggcuucaaccccggcgacaucuccgucgaguggaccuccaacggccacaccgaggagaacuacaaggacaccgcccccguccucgacuccgacggcuccuacuucaucuacuccaagcucaacaugaagaccuccaagugggagaagaccgacuccuucuccugcaacguccgccacgagggccucaagaacuacuaccucaagaagaccaucucccgcucccccggcaag

SEQ ID NO: 15895 - RNA, 657 nt, Artificial Sequence
  derived and/or modified sequence opt2 from Neuradiab_LightChain1
gacaucgucaugacccaggccgccuucuccaaccccgucacccucggcaccuccgccuccaucuccugccgcuccuccaagucccuccuccacuccaacggcaucaccuaccucuacugguaccuccagaagcccggccaguccccccagcuccucaucuaccagauguccaaccucgccuccggcguccccgaccgcuucuccuccuccggcuccggcaccgacuucacccuccgcaucucccgcgucgaggccgaggacgucggcgucuacuacugcgcccagaaccucgagcucccccgcaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 15896 - RNA, 369 nt, Artificial Sequence
  derived and/or modified sequence opt2 from Nimotuzumab_HeavyChain1
cagguccagcuccagcaguccggcgccgaggucaagaagcccggcuccuccgucaaggucuccugcaaggccuccggcuacaccuucaccaacuacuacaucuacuggguccgccaggcccccggccagggccucgaguggaucggcggcaucaaccccaccuccggcggcuccaacuucaacgagaaguucaagacccgcgucaccaucaccgucgacgaguccaccaacaccgccuacauggagcucuccucccuccgcuccgaggacaccgccuucuacuucugcgcccgccagggccucugguucgacuccgacggccgcggcuucgacuucuggggccagggcuccaccgucaccgucuccucc

SEQ ID NO: 15897 - RNA, 342 nt, Artificial Sequence
  derived and/or modified sequence opt2 from Nimotuzumab_LightChain1
gacauccagaugacccagucccccuccucccucuccgccuccgucggcgaccgcgucaccaucaccugccgcuccucccagaacaucguccacuccaacggcaacaccuaccucgacugguaccagcagacccccggcaaggcccccaagcuccucaucuacaaggucuccaaccgcuucuccggcguccccucccgcuucuccggcuccggcuccggcaccgacuucaccuucaccaucuccucccuccagcccgaggacaucgccaccuacuacugcuuccaguacucccacguccccuggaccuucggccagggcaccaagcuccagaucacccgcgag

SEQ ID NO: 15898 - RNA, 1320 nt, Artificial Sequence
  derived and/or modified sequence opt2 from Nivolumab_HeavyChain1
cagguccagcucgucgaguccggcggcggcgucguccagcccggccgcucccuccgccucgacugcaaggccuccggcaucaccuucuccaacuccggcaugcacuggguccgccaggcccccggcaagggccucgagugggucgccgucaucugguacgacggcuccaagcgcuacuacgccgacuccgucaagggccgcuucaccaucucccgcgacaacuccaagaacacccucuuccuccagaugaacucccuccgcgccgaggacaccgccgucuacuacugcgccaccaacgacgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15899 - RNA, 642 nt, Artificial Sequence
  derived and/or modified sequence opt2 from Nivolumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcaguccuccaacuggccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15900 - RNA, 1347 nt, Artificial Sequence
  derived and/or modified sequence opt2 from Obiltoxaximab_HeavyChain1
cagguccagcuccagcaguccggccccgagcucaagaagcccggcgccuccgucaaggucuccugcaaggacuccggcuacgccuucuccuccuccuggaugaacuggguccgccaggcccccggccagggccucgaguggaucggccgcaucuaccccggcgacggcgacaccaacuacaacggcaaguuccagggccgcgucaccaucaccgccgacaaguccuccuccaccgccuacauggagcucuccucccuccgcuccgaggacaccgccgucuacuucugcgcccgcuccggccuccuccgcuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15901 - RNA, 642 nt, Artificial Sequence
  derived and/or modified sequence opt2 from Obiltoxaximab_LightChain1
gacauccagaugacccagucccccuccucccucuccgccuccgucggcgaccgcgucaccaucaccugccgcgccucccaggacauccgcaacuaccucaacugguaccagcagaagcccggcaaggccgucaagcuccucaucuacuacaccucccgccuccuccccggcguccccucccgcuucuccggcuccggcuccggcaccgacuacucccucaccaucuccucccaggagcaggaggacaucggcaccuacuucugccagcagggcaacacccuccccuggaccuucggccagggcaccaaggucgagauccgccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15902 - RNA, 1347 nt, Artificial Sequence; identical to SEQ ID NO: 15306
  derived and/or modified sequence opt2 from Obinutuzumab_HeavyChain1

SEQ ID NO: 15903 - RNA, 657 nt, Artificial Sequence; identical to SEQ ID NO: 15307
  derived and/or modified sequence opt2 from Obinutuzumab_LightChain1

SEQ ID NO: 15904 - RNA, 1350 nt, Artificial Sequence
  derived and/or modified sequence opt2 from Ocaratuzumab_HeavyChain1
gagguccagcucguccaguccggcgccgaggucaagaagcccggcgagucccucaagaucuccugcaagggcuccggccgcaccuucaccuccuacaacaugcacuggguccgccagaugcccggcaagggccucgaguggaugggcgccaucuacccccucaccggcgacaccuccuacaaccagaaguccaagcuccaggucaccaucuccgccgacaaguccaucuccaccgccuaccuccagugguccucccucaaggccuccgacaccgccauguacuacugcgcccgcuccaccuacgucggcggcgacuggcaguucgacgucuggggcaagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagaucaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaagcagaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15905 - RNA, 639 nt, Artificial Sequence
  derived and/or modified sequence opt2 from Ocaratuzumab_LightChain1
gagaucguccucacccagucccccggcacccucucccucucccccggcgagcgcgccacccucuccugccgcgccuccuccuccguccccuacauccacugguaccagcagaagcccggccaggccccccgccuccucaucuacgccaccuccgcccucgccuccggcauccccgaccgcuucuccggcuccggcuccggcaccgacuucacccucaccaucucccgccucgagcccgaggacuucgccgucuacuacugccagcaguggcucuccaacccccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15906 - RNA, 1356 nt, Artificial Sequence
  derived and/or modified sequence opt2 from Ocrelizumab_HeavyChain1
gagguccagcucgucgaguccggcggcggccucguccagcccggcggcucccuccgccucuccugcgccgccuccggcuacaccuucaccuccuacaacaugcacuggguccgccaggcccccggcaagggccucgagugggucggcgccaucuaccccggcaacggcgacaccuccuacaaccagaaguucaagggccgcuucaccaucuccgucgacaaguccaagaacacccucuaccuccagaugaacucccuccgcgccgaggacaccgccgucuacuacugcgcccgcgucgucuacuacuccaacuccuacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15907 - RNA, 639 nt, Artificial Sequence
  derived and/or modified sequence opt2 from Ocrelizumab_LightChain1
gacauccagaugacccagucccccuccucccucuccgccuccgucggcgaccgcgucaccaucaccugccgcgccuccuccuccgucuccuacaugcacugguaccagcagaagcccggcaaggcccccaagccccucaucuacgcccccuccaaccucgccuccggcguccccucccgcuucuccggcuccggcuccggcaccgacuucacccucaccaucuccucccuccagcccgaggacuucgccaccuacuacugccagcagugguccuucaacccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15908 - RNA, 1356 nt, Artificial Sequence
  derived and/or modified sequence opt2 from Ofatumumab_HeavyChain1
gagguccagcucgucgaguccggcggcggccucguccagcccggccgcucccuccgccucuccugcgccgccuccggcuucaccuucaacgacuacgccaugcacuggguccgccaggcccccggcaagggccucgagugggucuccaccaucuccuggaacuccggcuccaucggcuacgccgacuccgucaagggccgcuucaccaucucccgcgacaacgccaagaagucccucuaccuccagaugaacucccuccgcgccgaggacaccgcccucuacuacugcgccaaggacauccaguacggcaacuacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15909 - RNA, 642 nt, Artificial Sequence
  derived and/or modified sequence opt2 from Ofatumumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15910 - RNA, 1371 nt, Artificial Sequence
  derived and/or modified sequence opt2 from Olaratumab_HeavyChain1
cagcuccagcuccaggaguccggccccggccucgucaagcccuccgagacccucucccucaccugcaccgucuccggcggcuccaucaacuccuccuccuacuacuggggcuggcuccgccagucccccggcaagggccucgaguggaucggcuccuucuucuacaccggcuccaccuacuacaaccccucccuccgcucccgccucaccaucuccgucgacaccuccaagaaccaguucucccucaugcucuccuccgucaccgccgccgacaccgccgucuacuacugcgcccgccaguccaccuacuacuacggcuccggcaacuacuacggcugguucgaccgcugggaccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15911 - RNA, 642 nt, Artificial Sequence
  derived and/or modified sequence opt2 from Olaratumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccccgccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15912 - RNA, 1341 nt, Artificial Sequence
  derived and/or modified sequence opt2 from Olizuab_HeavyChain1
gagguccagcucgucgaguccggcggcggccucguccagcccggcggcucccuccgccucuccugcgccgucuccggcuacuccaucaccuccggcuacuccuggaacuggauccgccaggcccccggcaagggccucgagugggucgccuccaucaccuacgacggcuccaccaacuacaaccccuccgucaagggccgcaucaccaucucccgcgacgacuccaagaacaccuucuaccuccagaacucccuccgcgccgaggacaccgccgucuacuacugcgcccgcggcucccacuacuucggccacuggcacuucgccgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 15913 - RNA, 651 nt, Artificial Sequence
  derived and/or modified sequence opt2 from Olizuab_LightChain1
gacauccagcucacccagucccccuccucccucuccgccuccgucggcgaccgcgucaccaucaccugccgcgccucccaguccgucgacuacgacggcgacuccuacaacugguaccagcagaagcccggcaaggcccccaagcuccucaucuacgccgccuccuaccucgaguccggcguccccucccgcuucuccggcuccggcuccggcaccgacuucacccucaccaucuccucccuccagcccgaggacuucgccaccuacuacugccagcagucccacgaggaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15914 - RNA, 1341 nt, Artificial Sequence
  derived and/or modified sequence opt2 from Olokizumab_HeavyChain1
gagguccagcucgucgaguccggcggcggccucguccagcccggcggcucccuccgccucuccugcgccgccuccggcuucaacuucaacgacuacuucaugaacuggguccgccaggcccccggcaagggccucgagugggucgcccagaugcgcaacaagaacuaccaguacggcaccuacuacgccgagucccucgagggccgcuucaccaucucccgcgacgacuccaagaacucccucuaccuccagaugaacucccucaagaccgaggacaccgccgucuacuacugcgcccgcgaguccuacuacggcuucaccuccuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 15915 - RNA, 642 nt, Artificial Sequence
  derived and/or modified sequence opt2 from Olokizumab_LightChain1
gacauccagaugacccagucccccuccucccucuccgccuccgucggcgaccgcgucaccaucaccugccaggccucccaggacaucggcaucucccucuccugguaccagcagaagcccggcaaggcccccaagcuccucaucuacaacgccaacaaccucgccgacggcguccccucccgcuucuccggcuccggcuccggcaccgacuucacccucaccaucuccucccuccagcccgaggacuucgccaccuacuacugccuccagcacaacuccgcccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15916 - RNA, 1341 nt, Artificial Sequence
  derived and/or modified sequence opt2 from Omalizumab_HeavyChain
gagguccagcucgucgaguccggcggcggccucguccagcccggcggcucccuccgccucuccugcgccgucuccggcuacuccaucaccuccggcuacuccuggaacuggauccgccaggcccccggcaagggccucgagugggucgccuccaucaccuacgacggcuccaccaacuacgccgacuccgucaagggccgcuucaccaucucccgcgacgacuccaagaacaccuucuaccuccagaugaacucccuccgcgccgaggacaccgccgucuacuacugcgcccgcggcucccacuacuucggccacuggcacuucgccgucuggggccagggcacccucgucaccgucuccuccggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15917 - RNA, 645 nt, Artificial Sequence
  derived and/or modified sequence opt2 from Omalizumab_LightChain
gacauccagcucacccagucccccuccucccucuccgccuccgucggcgaccgcgucaccaucaccugccgcgccucccaguccgucgacuacgacggcgacuccuacaugaacugguaccagcagaagcccggcaaggcccccaagcuccucaucuacgccgccuccuaccucgaguccggcguccccucccgcuucuccggcuccggcuccggcaccgacuucacccucaccaucuccucccuccagcccgaggacuucgccaccuacuacugccagcagucccacgaggaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 15918 - RNA, 1347 nt, Artificial Sequence
  derived and/or modified sequence opt2 from Onartuzumab_HeavyChain1
gagguccagcucgucgaguccggcggcggccucguccagcccggcggcucccuccgccucuccugcgccgccuccggcuacaccuucaccuccuacuggcuccacuggguccgccaggcccccggcaagggccucgagugggucggcaugaucgaccccuccaacuccgacacccgcuucaaccccaacuucaaggaccgcuucaccaucuccgccgacaccuccaagaacaccgccuaccuccagaugaacucccuccgcgccgaggacaccgccgucuacuacugcgccaccuaccgcuccuacgucaccccccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucuccugcgccgucaagggcuucuaccccuccgacaucgccgucgagugggaguccaacggccagcccgagaacaacuacaagaccaccccccccguccucgacuccgacggcuccuucuuccucgucuccaagcucaccgucgacaagucccgcuggcagcagggcaacgucuucuccugcuccgucaugcacgaggcccuccacaaccacuacacccagaagucccucucccucucccccggcaag

SEQ ID NO: 15919 - RNA, 681 nt, Artificial Sequence
  derived and/or modified sequence opt2 from Onartuzumab_HeavyChain2
gacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucuggugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15920 - RNA, 660 nt, Artificial Sequence
  derived and/or modified sequence opt2 from Onartuzumab_LightChain1
gacauccagaugacccagucccccuccucccucuccgccuccgucggcgaccgcgucaccaucaccugcaaguccucccagucccuccucuacaccuccucccagaagaacuaccucgccugguaccagcagaagcccggcaaggcccccaagcuccucaucuacugggccuccacccgcgaguccggcguccccucccgcuucuccggcuccggcuccggcaccgacuucacccucaccaucuccucccuccagcccgaggacuucgccaccuacuacugccagcaguacuacgccuaccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15921 - RNA, 1362 nt, Artificial Sequence
  derived and/or modified sequence opt2 from Ontuxizumab_HeavyChain1
cagguccagcuccaggaguccggccccggccucguccgccccucccagacccucucccucaccugcaccgccuccggcuacaccuucaccgacuacgucauccacugggucaagcagccccccggccgcggccucgaguggaucggcuacaucaaccccuacgacgacgacaccaccuacaaccagaaguucaagggccgcgucaccaugcucgucgacaccuccuccaacaccgccuaccuccgccucuccuccgucaccgccgaggacaccgccgucuacuacugcgcccgccgcggcaacuccuacgacggcuacuucgacuacuccauggacuacuggggcuccggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuucuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15922 - RNA, 645 nt, Artificial Sequence
  derived and/or modified sequence opt2 from Ontuxizumab_LightChain1
gacauccagaugacccagucccccuccucccucuccgccuccgucggcgaccgcgucaccaucaccugccgcgccucccagaacgucggcaccgccgucgccuggcuccagcagacccccggcaaggcccccaagcuccucaucuacuccgccuccaaccgcuacaccggcguccccucccgcuucuccggcuccggcuccggcaccgacuacaccuucaccaucuccucccuccagcccgaggacaucgccaccuacuacugccagcaguacaccaacuaccccauguacaccuucggccagggcaccaagguccagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15923 - RNA, 1341 nt, Artificial Sequence
  derived and/or modified sequence opt2 from Opicinumab_HeavyChain1
gagguccagcuccucgaguccggcggcggccucguccagcccggcggcucccuccgccucuccugcgccgccuccggcuucaccuucuccgccuacgagaugaaguggguccgccaggcccccggcaagggccucgagugggucuccgucaucggccccuccggcggcuucaccuucuacgccgacuccgucaagggccgcuucaccaucucccgcgacaacuccaagaacacccucuaccuccagaugaacucccuccgcgccgaggacaccgccgucuacuacugcgccaccgagggcgacaacgacgccuucgacaucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccgccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15924 - RNA, 645 nt, Artificial Sequence
  derived and/or modified sequence opt2 from Opicinumab_LightChain1
gacauccagaugacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggcccauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15925 - RNA, 1941 nt, Artificial Sequence
  derived and/or modified sequence opt2 from Oportuzumab_monatox_HeavyChain1
caccaccaccaccaccacgacauccagaugacccagucccccuccucccucuccgccuccgucggcgaccgcgucaccaucaccugccgcuccaccaagucccuccuccacuccaacggcaucaccuaccucuacugguaccagcagaagcccggcaaggcccccaagcuccucaucuaccagauguccaaccucgccuccggcguccccucccgcuucuccuccuccggcuccggcaccgacuucacccucaccaucuccucccuccagcccgaggacuucgccaccuacuacugcgcccagaaccucgagaucccccgcaccuucggccagggcaccaaggucgagcucaagcgcgccacccccucccacaacucccaccagguccccuccgccggcggccccaccgccaacuccggcaccuccggcuccgagguccagcucguccaguccggccccggccucguccagcccggcggcuccguccgcaucuccugcgccgccuccggcuacaccuucaccaacuacggcaugaacugggucaagcaggcccccggcaagggccucgaguggaugggcuggaucaacaccuacaccggcgaguccaccuacgccgacuccuucaagggccgcuucaccuucucccucgacaccuccgccuccgccgccuaccuccagaucaacucccuccgcgccgaggacaccgccgucuacuacugcgcccgcuucgccaucaagggcgacuacuggggccagggcacccuccucaccgucuccuccgaguucggcggcgcccccgaguuccccaagcccuccaccccccccggcuccuccggccucgagggcggcucccucgccgcccucaccgcccaccaggccugccaccucccccucgagaccuucacccgccaccgccagccccgcggcugggagcagcucgagcagugcggcuaccccguccagcgccucgucgcccucuaccucgccgcccgccucuccuggaaccaggucgaccaggucauccgcaacgcccucgccucccccggcuccggcggcgaccucggcgaggccauccgcgagcagcccgagcaggcccgccucgcccucacccucgccgccgccgaguccgagcgcuucguccgccagggcaccggcaacgacgaggccggcgccgccuccgccgacgucgucucccucaccugccccgucgccgccggcgagugcgccggccccgccgacuccggcgacgcccuccucgagcgcaacuaccccaccggcgccgaguuccucggcgacggcggcgacgucuccuucuccacccgcggcacccagaacuggaccgucgagcgccuccuccaggcccaccgccagcucgaggagcgcggcuacgucuucgucggcuaccacggcaccuuccucgaggccgcccaguccaucgucuucggcggcguccgcgcccgcucccaggaccucgacgccaucuggcgcggcuucuacaucgccggcgaccccgcccucgccuacggcuacgcccaggaccaggagcccgacgcccgcggccgcauccgcaacggcgcccuccuccgcgucuacgucccccgcuccucccuccccggcuucuaccgcaccggccucacccucgccgcccccgaggccgccggcgaggucgagcgccucaucggccacccccucccccuccgccucgacgccaucaccggccccgaggaggagggcggccgccucgagaccauccucggcuggccccucgccgagcgcaccgucgucauccccuccgccauccccaccgacccccgcaacgucggcggcgaccucgaccccuccuccauccccgacaaggagcaggccaucuccgcccuccccgacuacgccucccagcccggcaagcccccccaccaccaccaccaccacaaggacgagcuc

SEQ ID NO: 15926 - RNA, 1941 nt, Artificial Sequence; identical to SEQ ID NO: 15925
  derived and/or modified sequence opt2 from Oportuzumab_monatox_SingleChain_variable_fragment

SEQ ID NO: 15927 - RNA, 762 nt, Artificial Sequence
  derived and/or modified sequence opt2 from Oreptacog_alfa_HeavyChain1
aucgucggcggcaaggucugccccaagggcgagugccccuggcagguccuccuccucgucaacggcgcccagcucugcggcggcacccucaucaacaccaucugggucgucuccgccgcccacugcuucgacaagaucaagaacuggcgcaaccucaucgccguccucggcgagcacgaccucuccgagcacgacggcgacgagcagucccgccgcgucgcccaggucaucauccccuccaccuacguccccggcaccaccaaccacgacaucgcccuccuccgccuccaccagcccgucaaccucaccgaccacgucgucccccucugccuccccgagcgcaccuucuccgagcgcacccucgccuucguccgcuucucccucgucuccggcuggggccagcuccucgaccgcggcgccaccgcccucgagcucaugguccucaacgucccccgccucaugacccaggacugccuccagcagucccgcaaggucggcgacucccccaacaucaccgaguacauguucugcgccggcuacuccgacggcuccaaggacuccugcaagggcgacuccggcggcccccacgccacccacuaccgcggcaccugguaccucaccggcaucgucuccuggggccagggcugcgccaccgucggccacuucggcgucuacacccgcgucucccaguacaucgaguggcuccagaagcucaugcgcuccgagccccgccccggcguccuccuccgcgcccccuucccc

SEQ ID NO: 15928 - RNA, 456 nt, Artificial Sequence
  derived and/or modified sequence opt2 from Oreptacog_alfa_LightChain1
gccaacgccuuccucgaggagcuccgccagggcucccucgagcgcgagugcaaggaggagcagugcuccuucgaggaggcccgcgagaucuucgaggacgaggaggagaccaagcucuucuggaucuccuacuccgacggcgaccagugcgccuccucccccugccagaacggcggcuccugcaaggaccagcuccaguccuacaucugcuucugccuccccgccuucgagggccgcaacugcgagacccacaaggacgaccagcucaucugcgucaacgagaacggcggcugcgagcaguacugcuccgaccacaacggcaccaagcgcuccugccgcugccacgagggcuacucccuccucgccgacggcgucuccugcacccccaccgucgaguaccccugcggcaagauccccauccucgagaagcgcaacgccuccaagccccagggccgc

SEQ ID NO: 15929 - RNA, 1353 nt, Artificial Sequence
  derived and/or modified sequence opt2 from Orticumab_HeavyChain1
gagguccagcuccucgaguccggcggcggccucguccagcccggcggcucccuccgccucuccugcgccgccuccggcuucaccuucuccaacgccuggauguccuggguccgccaggcccccggcaagggccucgagugggucuccuccaucuccgucggcggccaccgcaccuacuacgccgacuccgucaagggccgcuccaccaucucccgcgacaacuccaagaacacccucuaccuccagaugaacucccuccgcgccgaggacaccgccgucuacuacugcgcccgcauccgcgucggccccuccggcggcgccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15930 - RNA, 648 nt, Artificial Sequence
  derived and/or modified sequence opt2 from Orticumab_LightChain1
caguccguccucacccagccccccuccgccuccggcacccccggccagcgcgucaccaucuccugcuccggcuccaacaccaacaucggcaagaacuacgucuccugguaccagcagcuccccggcaccgcccccaagcuccucaucuacgccaacuccaaccgccccuccggcguccccgaccgcuucuccggcuccaaguccggcaccuccgccucccucgccaucuccggccuccgcuccgaggacgaggccgacuacuacugcgccuccugggacgccucccucaacggcugggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15931 - RNA, 1347 nt, Artificial Sequence
  derived and/or modified sequence opt2 from Otelixizumab_HeavyChain1
gagguccagcuccucgaguccggcggcggccucguccagcccggcggcucccuccgccucuccugcgccgccuccggcuucaccuucuccuccuuccccauggccuggguccgccaggcccccggcaagggccucgagugggucuccaccaucuccaccuccggcggccgcaccuacuaccgcgacuccgucaagggccgcuucaccaucucccgcgacaacuccaagaacacccucuaccuccagaugaacucccuccgcgccgaggacaccgccgucuacuacugcgccaaguuccgccaguacuccggcggcuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15932 - RNA, 648 nt, Artificial Sequence
  derived and/or modified sequence opt2 from Otelixizumab_LightChain1
gacauccagcucacccagcccaacuccgucuccaccucccucggcuccaccgucaagcucuccugcacccucuccuccggcaacaucgagaacaacuacguccacugguaccagcucuacgagggccgcucccccaccaccaugaucuacgacgacgacaagcgccccgacggcguccccgaccgcuucuccggcuccaucgaccgcuccuccaacuccgccuuccucaccauccacaacgucgccaucgaggacgaggccaucuacuucugccacuccuacgucuccuccuucaacgucuucggcggcggcaccaagcucaccguccuccgccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15933 - RNA, 1449 nt, Artificial Sequence
  derived and/or modified sequence opt2 from Otlertuzumab_HeavyChain1
gagguccagcucguccaguccggcgccgaggucaagaagcccggcgagucccucaagaucuccugcaagggcuccggcuacuccuucaccggcuacaacaugaacuggguccgccagaugcccggcaagggccucgaguggaugggcaacaucgaccccuacuacggcggcaccaccuacaaccgcaaguucaagggccaggucaccaucuccgccgacaaguccaucuccaccgccuaccuccagugguccucccucaaggccuccgacaccgccauguacuacugcgcccgcuccgucggccccuucgacuccuggggccagggcacccucgucaccgucuccuccggcggcggcggcuccggcggcggcggcuccggcggcggcggcuccggcggcggcggcuccggcggcggcggcuccgagaucguccucacccagucccccgccacccucucccucucccccggcgagcgcgccacccucuccugccgcgccuccgagaacgucuacuccuaccucgccugguaccagcagaagcccggccaggccccccgccuccucaucuacuucgccaagacccucgccgagggcauccccgcccgcuucuccggcuccggcuccggcaccgacuucacccucaccaucuccucccucgagcccgaggacuucgccgucuacuacugccagcaccacuccgacaaccccuggaccuucggccagggcaccaaggucgagaucaagggcgaccaggagcccaaguccuccgacaagacccacaccuccccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15934 - RNA, 1347 nt, Artificial Sequence
  derived and/or modified sequence opt2 from Oxelumab_HeavyChain1
gagguccagcuccucgaguccggcggcggccucguccagcccggcggcucccuccgccucuccugcgccgccuccggcuucaccuucaacuccuacgccauguccuggguccgccaggcccccggcaagggccucgagugggucuccaucaucuccggcuccggcggcuucaccuacuacgccgacuccgucaagggccgcuucaccaucucccgcgacaacucccgcaccacccucuaccuccagaugaacucccuccgcgccgaggacaccgccgucuacuacugcgccaaggaccgccucgucgcccccggcaccuucgacuacuggggccagggcgcccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15935 - RNA, 642 nt, Artificial Sequence
  derived and/or modified sequence opt2 from Oxelumab_LightChain1
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15936 - RNA, 1329 nt, Artificial Sequence
  derived and/or modified sequence opt2 from Ozanezumab_HeavyChain1
cagguccagcucguccaguccggcgccgaggucaagaagcccggcgccuccgucaaggucuccugcaaggccuccggcuacaccuucaccuccuacuggaugcacuggguccgccaggcccccggccagggccucgaguggaucggcaacaucaaccccuccaacggcggcaccaacuacaacgagaaguucaaguccaaggccaccaugacccgcgacaccuccaccuccaccgccuacauggagcucuccucccuccgcuccgaggacaccgccgucuacuacugcgagcucaugcagggcuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15937 - RNA, 657 nt, Artificial Sequence
  derived and/or modified sequence opt2 from Ozanezumab_LightChain1
gacaucgucaugacccaguccccccucuccaaccccgucacccucggccagcccgucuccaucuccugccgcuccuccaagucccuccucuacaaggacggcaagaccuaccucaacugguuccuccagcgccccggccaguccccccagcuccucaucuaccucauguccacccgcgccuccggcguccccgaccgcuucuccggcggcggcuccggcaccgacuucacccucaagaucucccgcgucgaggccgaggacgucggcgucuacuacugccagcagcucgucgaguacccccucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15938 - RNA, 1089 nt, Artificial Sequence
  derived and/or modified sequence opt2 from Ozoralizumab_HeavyChain1
gagguccagcucgucgaguccggcggcggccucguccagcccggcggcucccuccgccucuccugcgccgccuccggcuucaccuucuccgacuacuggauguacuggguccgccaggcccccggcaagggccucgagugggucuccgagaucaacaccaacggccucaucaccaaguaccccgacuccgucaagggccgcuucaccaucucccgcgacaacgccaagaacacccucuaccuccagaugaacucccuccgccccgaggacaccgccgucuacuacugcgcccgcucccccuccggcuucaaccgcggccagggcacccucgucaccgucuccuccggcggcggcggcuccggcggcggcuccgagguccagcucgucgaguccggcggcggccucguccagcccggcaacucccuccgccucuccugcgccgccuccggcuucaccuucuccuccuucggcauguccuggguccgccaggcccccggcaagggccucgagugggucuccuccaucuccggcuccggcuccgacacccucuacgccgacuccgucaagggccgcuucaccaucucccgcgacaacgccaagaccacccucuaccuccagaugaacucccuccgccccgaggacaccgccgucuacuacugcaccaucggcggcucccucucccgcuccucccagggcacccucgucaccgucuccuccggcggcggcggcuccggcggcggcuccgagguccagcucgucgaguccggcggcggccucguccagcccggcggcucccuccgccucuccugcgccgccuccggcuucaccuucuccgacuacuggauguacuggguccgccaggcccccggcaagggccucgagugggucuccgagaucaacaccaacggccucaucaccaaguaccccgacuccgucaagggccgcuucaccaucucccgcgacaacgccaagaacacccucuaccuccagaugaacucccuccgccccgaggacaccgccgucuacuacugcgcccgcucccccuccggcuucaaccgcggccagggcacccucgucaccgucuccucc

SEQ ID NO: 15939 - RNA, 1350 nt, Artificial Sequence
  derived and/or modified sequence opt2 from Palivizumab_HeavyChain
caggucacccuccgcgaguccggccccgcccucgucaagcccacccagacccucacccucaccugcaccuucuccggcuucucccucuccaccuccggcauguccgucggcuggauccgccagccccccggcaaggcccucgaguggcucgccgacaucuggugggacgacaagaaggacuacaaccccucccucaagucccgccucaccaucuccaaggacaccuccaagaaccaggucguccucaaggucaccaacauggaccccgccgacaccgccaccuacuacugcgcccgcuccaugaucaccaacugguacuucgacgucuggggcgccggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15940 - RNA, 639 nt, Artificial Sequence
  derived and/or modified sequence opt2 from Palivizumab_LightChain
gacauccagaugacccagucccccuccacccucuccgccuccgucggcgaccgcgucaccaucaccugcaagugccagcucuccgucggcuacaugcacugguaccagcagaagcccggcaaggcccccaagcuccucaucuacgacaccuccaagcucgccuccggcguccccucccgcuucuccggcuccggcuccggcaccgaguucacccucaccaucuccucccuccagcccgacgacuucgccaccuacuacugcuuccagggcuccggcuaccccuucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15941 - RNA, 360 nt, Artificial Sequence
  derived and/or modified sequence opt2 from Palivizumab_VH-Region
caggucacccuccgcgaguccggccccgcccucgucaagcccacccagacccucacccucaccugcaccuucuccggcuucucccucuccaccuccggcauguccgucggcuggauccgccagccccccggcaaggcccucgaguggcucgccgacaucuggugggacgacaagaaggacuacaaccccucccucaagucccgccucaccaucuccaaggacaccuccaagaaccaggucguccucaaggucaccaacauggaccccgccgacaccgccaccuacuacugcgcccgcuccaugaucaccaacugguacuucgacgucuggggcgccggcaccaccgucaccgucuccucc

SEQ ID NO: 15942 - RNA, 1347 nt, Artificial Sequence; identical to SEQ ID NO: 15578
  derived and/or modified sequence opt2 from Pamrevlumab_HeavyChain1

SEQ ID NO: 15943 - RNA, 642 nt, Artificial Sequence; identical to SEQ ID NO: 15579
  derived and/or modified sequence opt2 from Pamrevlumab_LightChain1

SEQ ID NO: 15944 - RNA, 1305 nt, Artificial Sequence
  derived and/or modified sequence opt2 from Panitumumab_HeavyChain1
cagguccagcuccaggaguccggccccggccucgucaagcccuccgagacccucucccucaccugcaccgucuccggcggcuccgucuccuccggcgacuacuacuggaccuggauccgccagucccccggcaagggccucgaguggaucggccacaucuacuacuccggcaacaccaacuacaaccccucccucaagucccgccucaccaucuccaucgacaccuccaagacccaguucucccucaagcucuccuccgucaccgccgccgacaccgccaucuacuacugcguccgcgaccgcgucaccggcgccuucgacaucuggggccagggcaccauggucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacgagcgcaagugcugcgucgagugccccgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15945 - RNA, 642 nt, Artificial Sequence
  derived and/or modified sequence opt2 from Panitumumab_LightChain1
gacauccagaugacccagucccccuccucccucuccgccuccgucggcgaccgcgucaccaucaccugccaggccucccaggacaucuccaacuaccucaacugguaccagcagaagcccggcaaggcccccaagcuccucaucuacgacgccuccaaccucgagaccggcguccccucccgcuucuccggcuccggcuccggcaccgacuucaccuucaccaucuccucccuccagcccgaggacaucgccaccuacuucugccagcacuucgaccaccucccccucgccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15946 - RNA, 1326 nt, Artificial Sequence
  derived and/or modified sequence opt2 from Pankoab_HeavyChain1
gagguccagcucgucgaguccggcggcggccucguccagcccggcggcucccgccucuccugcgucgccuccggcuuccccuucuccaacuacuggaacuggguccgccaggcccccggcaagggccucgagugggucggcgagauccgccucaaguccaacaacuacaccacccacuacgccgaguccgucaagggccgcuucaccaucucccgcgacgacuccaagaacucccucuaccuccagaacucccucaagaccgaggacaccgccgucuacuacugcacccgccacuacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgagggccuccacaaccacuacacccagaagucccucucccucucccccggcaag

SEQ ID NO: 15947 - RNA, 651 nt, Artificial Sequence
  derived and/or modified sequence opt2 from Pankoab_LightChain1
gacaucgucacccaguccccccucuccaaccccgucacccccggcgagcccgccuccaucuccugccgcuccuccaagucccuccuccacuccaacggcaucaccuacuucuucugguaccuccagaagcccggccaguccccccagcuccucaucuaccaguccaaccucgccuccggcguccccgaccgcuucuccggcuccggcuccggcaccgacuucacccuccgcaucucccgcgucgaggccgaggacgucggcgucuacuacugcgcccagaaccucgagcucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15948 - RNA, 651 nt, Artificial Sequence
  derived and/or modified sequence opt2 from Pankoab_LightChain2
gacaucgucacccaguccccccucuccaaccccgucacccccggcgagcccgccuccaucuccugccgcuccuccaagucccuccuccacuccaacggcaucaccuacuucuucugguaccuccagaagcccggccaguccccccagcuccucaucuaccaguccaaccucgccuccggcguccccgaccgcuucuccggcuccggcuccggcaccgacuucacccuccgcaucucccgcgucgaggccgaggacgucggcgucuacuacugcgccggcaaccucgagcucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15949 - RNA, 351 nt, Artificial Sequence
  derived and/or modified sequence opt2 from PankoMab_HeavyChain_VDJ-Region
gaggucaagcucgucgaguccggcggcggccucguccagcccggcggcuccaugaagcucuccugcgucgccuccggcuucaccuucuccaacuacuggaugaacuggguccgccagucccccgagaagggccucgagugggucgccgagauccgccucaaguccaacaacuacaccacccacuacgccgaguccgucaagggccgcuucaccaucucccgcgacgacuccaaguccuccgucucccuccagaugaacaaccuccgcgucgaggacaccggcaucuacuacugcacccgccacuacuacuucgacuacuggggccagggcaccacccucaccgucuccucc

SEQ ID NO: 15950 - RNA, 339 nt, Artificial Sequence
  derived and/or modified sequence opt2 from PankoMab_LightChain_VJ-Region
gacaucgucaugacccaggccgccuucuccaaccccgucacccucggcaccuccgccuccaucuccugccgcuccuccaagucccuccuccacuccaacggcaucaccuacuucuucugguaccuccagaagcccggccucuccccccagcuccucaucuaccagauguccaaccucgccuccggcguccccgaccgcuucuccuccuccggcuccggcaccgacuucacccuccgcaucucccgcgucgaggccgaggacgucggcgucuacuacugcgcccagaaccucgagcucccccccaccuucggcggcggcaccaagcucgagaucaagcgc

SEQ ID NO: 15951 - RNA, 1707 nt, Artificial Sequence
  derived and/or modified sequence opt2 from Panobacumab_HeavyChain1
gaggagcaggucgucgaguccggcggcggcuucguccagcccggcggcucccuccgccucuccugcgccgccuccggcuucaccuucucccccuacuggaugcacuggguccgccaggcccccggcaagggccucgucugggucucccgcaucaacuccgacggcuccaccuacuacgccgacuccgucaagggccgcuucaccaucucccgcgacaacgcccgcaacacccucuaccuccagaugaacucccuccgcgccgaggacaccgccgucuacuacugcgcccgcgaccgcuacuacggccccgagauguggggccagggcaccauggucaccgucuccuccggcuccgccuccgcccccacccucuucccccucgucuccugcgagaacucccccuccgacaccuccuccgucgccgucggcugccucgcccaggacuuccuccccgacuccaucaccuucuccuggaaguacaagaacaacuccgacaucuccuccacccgcggcuuccccuccguccuccgcggcggcaaguacgccgccaccucccagguccuccuccccuccaaggacgucaugcagggcaccgacgagcacgucgucugcaagguccagcaccccaacggcaacaaggagaagaacgucccccuccccgucaucgccgagcucccccccaaggucuccgucuucguccccccccgcgacggcuucuucggcaacccccgcaaguccaagcucaucugccaggccaccggcuucuccccccgccagauccaggucuccuggcuccgcgagggcaagcaggucggcuccggcgucaccaccgaccagguccaggccgaggccaaggaguccggccccaccaccuacaaggucaccuccacccucaccaucaaggaguccgacuggcucucccaguccauguucaccugccgcgucgaccaccgcggccucaccuuccagcagaacgccuccuccaugugcguccccgaccaggacaccgccauccgcgucuucgccaucccccccuccuucgccuccaucuuccucaccaaguccaccaagcucaccugccucgucaccgaccucaccaccuacgacuccgucaccaucuccuggacccgccagaacggcgaggccgucaagacccacaccaacaucuccgagucccaccccaacgccaccuucuccgccgucggcgaggccuccaucugcgaggacgacuggaacuccggcgagcgcuucaccugcaccgucacccacaccgaccuccccuccccccucaagcagaccaucucccgccccaagggcgucgcccuccaccgccccgacgucuaccuccucccccccgcccgcgagcagcucaaccuccgcgaguccgccaccaucaccugccucgucaccggcuucucccccgccgacgucuucguccaguggaugcagcgcggccagccccucucccccgagaaguacgucaccuccgcccccaugcccgagccccaggcccccggccgcuacuucgcccacuccauccucaccgucuccgaggaggaguggaacaccggcgagaccuacaccugcgucgucgcccacgaggcccuccccaaccgcgucaccgagcgcaccgucgacaaguccaccggcaagcccacccucuacaacgucucccucgucauguccgacaccgccggcaccugcuac

SEQ ID NO: 15952 - RNA, 657 nt, Artificial Sequence
  derived and/or modified sequence opt2 from Panobacumab_LightChain1
gacgucgucaugacccaguccccccucucccuccccgucacccucggccagcccgccuccaucuccugccgcuccucccagucccucgucuacuccgacggcaacaccuaccucaacugguuccagcagcgccccggccaguccccccgccgccucaucuacaaggucuccaaccgcgacuccggcguccccgaccgcuucuccggcuccggcuccggcaccgacuucacccucaagaucucccgcgucgaggccgaggacgucggcgucuacuacugcaugcagggcacccacuggccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15953 - RNA, 414 nt, Artificial Sequence
  derived and/or modified sequence opt2 from Panobacumab_LightChain2
ggcgacgacgaggccaccauccucgccgacaacaagugcaugugcacccgcgucaccucccgcaucauccccuccaccgaggaccccaacgaggacaucgucgagcgcaacauccgcaucgucgucccccucaacaaccgcgagaacaucuccgaccccaccuccccccuccgccgcaacuucgucuaccaccucuccgacgucugcaagaagugcgaccccgucgaggucgagcucgaggaccaggucgucaccgccacccaguccaacaucugcaacgaggacgacggcguccccgagaccugcuacauguacgaccgcaacaagugcuacaccaccauggucccccuccgcuaccacggcgagaccaagaugguccaggccgcccucacccccgacuccugcuaccccgac

SEQ ID NO: 15954 - RNA, 1359 nt, Artificial Sequence
  derived and/or modified sequence opt2 from Parsatuzumab_HeavyChain1
gagguccagcucgucgaguccggcggcggccucguccagcccggcggcucccuccgccucuccugcgccgccuccggcuacaccuucaucgacuacuacaugaacuggguccgccaggcccccggcaagggccucgagugggucggcgacaucaaccucgacaacuccggcacccacuacaaccagaaguucaagggccgcuucaccaucucccgcgacaaguccaagaacaccgccuaccuccagaugaacucccuccgcgccgaggacaccgccgucuacuacugcgcccgcgagggcgucuaccacgacuacgacgacuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15955 - RNA, 657 nt, Artificial Sequence
  derived and/or modified sequence opt2 from Parsatuzumab_LightChain1
gacauccagaugacccagucccccuccucccucuccgccuccgucggcgaccgcgucaccaucaccugccgcaccucccagucccucguccacaucaacgccaucaccuaccuccacugguaccagcagaagcccggcaaggcccccaagcuccucaucuaccgcgucuccaaccgcuucuccggcguccccucccgcuucuccggcuccggcuccggcaccgacuucacccucaccaucuccucccuccagcccgaggacuucgccaccuacuacugcggccaguccacccacgucccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15956 - RNA, 1353 nt, Artificial Sequence
  derived and/or modified sequence opt2 from Pascolizumab_HeavyChain1
caggucacccuccgcgaguccggccccgcccucgucaagcccacccagacccucacccucaccugcaccuucuccggcuucucccucuccaccuccggcaugggcgucuccuggauccgccagccccccggcaagggccucgaguggcucgcccacaucuacugggacgacgacaagcgcuacaaccccucccucaagucccgccucaccaucuccaaggacaccucccgcaaccaggucguccucaccaugaccaacauggaccccgucgacaccgccaccuacuacugcgcccgccgcgagaccgucuucuacugguacuucgacgucuggggccgcggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15957 - RNA, 654 nt, Artificial Sequence
  derived and/or modified sequence opt2 from Pascolizumab_LightChain1
gacaucguccucacccagucccccuccucccucuccgccuccgucggcgaccgcgucaccaucaccugcaaggccucccaguccgucgacuacgacggcgacuccuacaugaacugguaccagcagaagcccggcaaggcccccaagcuccucaucuacgccgccuccaaccucgaguccggcauccccucccgcuucuccggcuccggcuccggcaccgacuucaccuucaccaucuccucccuccagcccgaggacaucgccaccuacuacugccagcaguccaacgaggacccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15958 - RNA, 1512 nt, Artificial Sequence
  derived and/or modified sequence opt2 from Pasotuxizumab_HeavyChain1
cagguccagcucgucgaguccggcggcggccucgucaagcccggcgagucccuccgccucuccugcgccgccuccggcuucaccuucuccgacuacuacauguacuggguccgccaggcccccggcaagggccucgagugggucgccaucaucuccgacggcggcuacuacaccuacuacuccgacaucaucaagggccgcuucaccaucucccgcgacaacgccaagaacucccucuaccuccagaugaacucccucaaggccgaggacaccgccgucuacuacugcgcccgcggcuucccccuccuccgccacggcgccauggacuacuggggccagggcacccucgucaccgucuccuccggcggcggcggcuccggcggcggcggcuccggcggcggcggcuccgacauccagaugacccagucccccuccucccucuccgccuccgucggcgaccgcgucaccaucaccugcaaggccucccagaacgucgacaccaacgucgccugguaccagcagaagcccggccaggcccccaagucccucaucuacuccgccuccuaccgcuacuccgacguccccucccgcuucuccggcuccgccuccggcaccgacuucacccucaccaucuccuccguccaguccgaggacuucgccaccuacuacugccagcaguacgacuccuaccccuacaccuucggcggcggcaccaagcucgagaucaaguccggcggcggcggcuccgagguccagcucgucgaguccggcggcggccucguccagcccggcggcucccucaagcucuccugcgccgccuccggcuucaccuucaacaaguacgccaugaacuggguccgccaggcccccggcaagggccucgagugggucgcccgcauccgcuccaaguacaacaacuacgccaccuacuacgccgacuccgucaaggaccgcuucaccaucucccgcgacgacuccaagaacaccgccuaccuccagaugaacaaccucaagaccgaggacaccgccgucuacuacugcguccgccacggcaacuucggcaacuccuacaucuccuacugggccuacuggggccagggcacccucgucaccgucuccuccggcggcggcggcuccggcggcggcggcuccggcggcggcggcucccagaccgucgucacccaggagcccucccucaccgucucccccggcggcaccgucacccucaccugcggcuccuccaccggcgccgucaccuccggcaacuaccccaacuggguccagcagaagcccggccaggccccccgcggccucaucggcggcaccaaguuccucgcccccggcacccccgcccgcuucuccggcucccuccucggcggcaaggccgcccucacccucuccggcguccagcccgaggacgaggccgaguacuacugcguccucugguacuccaaccgcugggucuucggcggcggcaccaagcucaccguccuccaccaccaccaccaccac

SEQ ID NO: 15959 - RNA, 1512 nt, Artificial Sequence
  derived and/or modified sequence opt2 from Pasotuxizumab_SingleChain
cagguccagcucguccaguccggcggcggccucgucaagcccggcgagucccuccgccucuccugcgccgccuccggcuucaccuucuccgacuacuacauguacuggguccgccaggcccccggcaagggccucgagugggucgccaucaucuccgacggcggcuacuacaccuacuacuccgacaucaucaagggccgcuucaccaucucccgcgacaacgccaagaacucccucuaccuccagaugaacucccucaaggccgaggacaccgccgucuacuacugcgcccgcggcuucccccuccuccgccacggcgccauggacuacuggggccagggcacccucgucaccgucuccuccggcggcggcggcuccggcggcggcggcuccggcggcggcggcuccgacauccagaugacccagucccccuccucccucuccgccuccgucggcgaccgcgucaccaucaccugcaaggccucccagaacgucgacaccaacgucgccugguaccagcagaagcccggccaggcccccaagucccucaucuacuccgccuccuaccgcuacuccgacguccccucccgcuucuccggcuccgccuccggcaccgacuucacccucaccaucuccuccguccaguccgaggacuucgccaccuacuacugccagcaguacgacuccuaccccuacaccuucggcggcggcaccaagcucgagaucaaguccggcggcggcggcuccgagguccagcucgucgaguccggcggcggccucguccagcccggcggcucccucaagcucuccugcgccgccuccggcuucaccuucaacaaguacgccaugaacuggguccgccaggcccccggcaagggccucgagugggucgcccgcauccgcuccaaguacaacaacuacgccaccuacuacgccgacuccgucaaggaccgcuucaccaucucccgcgacgacuccaagaacaccgccuaccuccagaugaacaaccucaagaccgaggacaccgccgucuacuacugcguccgccacggcaacuucggcaacuccuacaucuccuacugggccuacuggggccagggcacccucgucaccgucuccuccggcggcggcggcuccggcggcggcggcuccggcggcggcggcucccagaccgucgucacccaggagcccucccucaccgucucccccggcggcaccgucacccucaccugcggcuccuccaccggcgccgucaccuccggcaacuaccccaacuggguccagcagaagcccggccaggccccccgcggccucaucggcggcaccaaguuccucgcccccggcacccccgcccgcuucuccggcucccuccucggcggcaaggccgcccucacccucuccggcguccagcccgaggacgaggccgaguacuacugcguccucugguacuccaaccgcugggucuucggcggcggcaccaagcucaccguccuccaccaccaccaccaccac

SEQ ID NO: 15960 - RNA, 1341 nt, Artificial Sequence
  derived and/or modified sequence opt2 from Pateclizumab_HeavyChain1
gagguccagcucgucgaguccggcggcggccucguccagcccggcggcucccuccgccucuccugcgccgccuccggcuacaccuucaccuccuacgucauccacuggguccgccaggcccccggcaagggccucgagugggucggcuacaacaaccccuacaacgccggcaccaacuacaacgagaaguucaagggccgcuucaccaucuccuccgacaaguccaagaacaccgccuaccuccagaugaacucccuccgcgccgaggacaccgccgucuacuacugcucccgccccaccaugcuccccugguucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15961 - RNA, 642 nt, Artificial Sequence
  derived and/or modified sequence opt2 from Pateclizumab_LightChain1
gacauccagaugacccagucccccuccucccucuccgccuccgucggcgaccgcgucaccaucaccugccgcgccucccaggccgucuccuccgccgucgccugguaccagcagaagcccggcaaggcccccaagcuccucaucuacuccgccucccaccgcuacaccggcguccccucccgcuucuccggcuccggcuccggcaccgacuucacccucaccaucuccucccuccagcccgaggacuucgccaccuacuacugccaggaguccuacuccacccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15962 - RNA, 1341 nt, Artificial Sequence
  derived and/or modified sequence opt2 from Patritumab_HeavyChain1
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagaucaaccacuccggcuccaccaacuacaaccccucccucaagucccgcgucaccaucuccgucgagaccuccaagaaccaguucucccucaagcucuccuccgucaccgccgccgacaccgccgucuacuacugcgcccgcgacaaguggaccugguacuucgaccucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15963 - RNA, 681 nt, Artificial Sequence; identical to SEQ ID NO: 15919
  derived and/or modified sequence opt2 from Patritumab_hinge-CH2-CH3

SEQ ID NO: 15964 - RNA, 660 nt, Artificial Sequence
  derived and/or modified sequence opt2 from Patritumab_LightChain1
gacaucgagaugacccagucccccgacucccucgccgucucccucggcgagcgcgccaccaucaacugccgcuccucccaguccguccucuacuccuccuccaaccgcaacuaccucgccugguaccagcagaaccccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccagcaguacuacuccaccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15965 - RNA, 1341 nt, Artificial Sequence; identical to SEQ ID NO: 15780
  derived and/or modified sequence opt2 from Pembrolizumab_HeavyChain1

SEQ ID NO: 15966 - RNA, 654 nt, Artificial Sequence; identical to SEQ ID NO: 15781
  derived and/or modified sequence opt2 from Pembrolizumab_LightChain1

SEQ ID NO: 15967 - RNA, 1356 nt, Artificial Sequence
  derived and/or modified sequence opt2 from Perakizumab_HeavyChain1
gagguccagcucgucgaguccggcggcggccucguccagcccggcggcucccuccgccucuccugcgccgccuccggcuucaccuucuccgacuacaccaugcucuggguccgccaggcccccggcaagggccucgagugggucgccaucaucaaguccggcggcuccuacuccuacuaccccgacuccgucaagggccgcuucaccaucucccgcgacaacgccaagaacucccucuaccuccagaugaacucccuccgcgccgaggacaccgccgucuacuacugcgcccgcgacggcgacuacggcuccuccuacggcgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15968 - RNA, 645 nt, Artificial Sequence
  derived and/or modified sequence opt2 from Perakizumab_LightChain1
gacauccagaugacccagucccccuccucccucuccgccuccgucggcgaccgcgucaccaucaccugccgcgccucccaggacaucaacuccuaccucuccugguuccagcagaagcccggcaaggcccccaagucccucaucguccgcgccaaccgccucgucgacggcguccccucccgcuucuccggcuccggcuccggccaggacuacucccucaccaucuccucccuccagcccgaggacuucgccaccuacuacugccuccaguacgacgccuucccccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15969 - RNA, 1332 nt, Artificial Sequence
  derived and/or modified sequence opt2 from Pertuzuab_HeavyChain1
gagguccagcucgucgaguccggcggcggccucguccagcccggcggcucccuccgccucuccugcgccgccuccggcuucaccuucaccgacuacaccgacuggguccgccaggcccccggcaagggccucgagugggucgccgacgucaaccccaacuccggcggcuccaucuacaaccagcgcuucaagggccgcuucacccucuccgucgaccgcuccaagaacacccucuaccuccagaacucccuccgcgccgaggacaccgccgucuacuacugcgcccgcaaccucggccccuccuucuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 15970 - RNA, 639 nt, Artificial Sequence
  derived and/or modified sequence opt2 from Pertuzuab_LightChain1
gacauccagacccagucccccuccucccucuccgccuccgucggcgaccgcgucaccaucaccugcaaggccucccaggacgucuccaucggcgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcaguacuacaucuaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15971 - RNA, 642 nt, Artificial Sequence
  derived and/or modified sequence opt2 from Pertuzumab_HeavyChain
gacauccagaugacccagucccccuccucccucuccgccuccgucggcgaccgcgucaccaucaccugcaaggccucccaggacgucuccaucggcgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcaguacuacaucuaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15972 - RNA, 1344 nt, Artificial Sequence
  derived and/or modified sequence opt2 from Pertuzumab_LightChain
gagguccagcucgucgaguccggcggcggccucguccagcccggcggcucccuccgccucuccugcgccgccuccggcuucaccuucaccgacuacaccauggacuggguccgccaggcccccggcaagggccucgagugggucgccgacgucaaccccaacuccggcggcuccaucuacaaccagcgcuucaagggccgcuucacccucuccgucgaccgcuccaagaacacccucuaccuccagaugaacucccuccgcgccgaggacaccgccgucuacuacugcgcccgcaaccucggccccuccuucuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 15973 - RNA, 750 nt, Artificial Sequence
  derived and/or modified sequence opt2 from Pexelizumab_h5g1.1-scFv
auggccgacauccagaugacccagucccccuccucccucuccgccuccgucggcgaccgcgucaccaucaccugcggcgccuccgagaacaucuacggcgcccucaacugguaccagcgcaagcccggcaaggcccccaagcuccucaucuacggcgccaccaaccucgccgacggcguccccucccgcuucuccggcuccggcuccggcaccgacuacacccucaccaucuccucccuccagcccgaggacuucgccaccuacuacugccagaacguccucaacaccccccucaccuucggccagggcaccaaggucgagaucaagcgcaccggcggcggcggcuccggcggcggcggcuccggcggcggcggcucccagguccagcucguccaguccggcgccgaggucgagaagcccggcgccuccgucaagaaggucuccugcaaggccuccggcuacaucuucuccaacuacuggauccaguggguccgccaggcccccggccagggccucgaguggaugggcgagauccuccccggcuccggcuccaccgaguacgcccagaaguuccagggccgcgucaccaugaccgccgacaccuccaccuccaccgccuacauggagcucuccucccuccgcuccgaggacaccgccgucuacuacugcgcccgcuacuucuucggcuccucccccaacuacugguacuucgacgucuggggccagggcacccucgucaccgucuccucc

SEQ ID NO: 15974 - RNA, 345 nt, Artificial Sequence
  derived and/or modified sequence opt2 from Pexelizumab_h5g1.1VHC_+_F_Heavy_Chain_V-Region
cagguccagcucguccaguccggcgccgaggucaagaagcccggcgccuccgucaaggucuccugcaaggccuccggcuacaucuucuccaacuacuggauccaguggguccgccaggcccccggccagggccucgaguggaugggcgagauccuccccggcuccggcuccaccgaguacgcccagaaguuccagggccgcgucaccaugaccgccgacaccuccaccuccaccgccuacauggagcucuccucccuccgcuccgaggacaccgccgucuacuacugcgcccgcuacuucuucggcuccucccccaacugguacuucgucuggggccagggcacc

SEQ ID NO: 15975 - RNA, 318 nt, Artificial Sequence
  derived and/or modified sequence opt2 from Pexelizumab_h5g1.1VHC_+_F_Light_Chain_V-Region
gacauccagaugacccagucccccucccucuccgccuccgucggcgaccgcgucaccaucaccugcggcgccuccgagaacaucuacggcgcccucaacugguaccagcgcaagcccggcaaggcccccaagcuccucaucuacggcgccaccaaccucgccgacggcguccccucccgcuucuccggcuccggcuccggcaccgacuacacccucaccaucuccucccuccagcccgaggacuucgccaccuacuacugccagaacguccucaacaccccccucaccuucggccagggcaccaaggucgagaucaag

SEQ ID NO: 15976 - RNA, 1326 nt, Artificial Sequence
  derived and/or modified sequence opt2 from PF-05082566_HeavyChain1
gagguccagcucguccaguccggcgccgaggucaagaagcccggcgagucccuccgcaucuccugcaagggcuccggcuacuccuucuccaccuacuggaucuccuggguccgccagaugcccggcaagggccucgaguggaugggcaagaucuaccccggcgacuccuacaccaacuacucccccuccuuccagggccaggucaccaucuccgccgacaaguccaucuccaccgccuaccuccagugguccucccucaaggccuccgacaccgccauguacuacugcgcccgcggcuacggcaucuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15977 - RNA, 642 nt, Artificial Sequence
  derived and/or modified sequence opt2 from PF-05082568_LightChain1
uccuacgagcucacccagccccccuccgucuccgucucccccggccagaccgccuccaucaccugcuccggcgacaacaucggcgaccaguacgcccacugguaccagcagaagcccggccagucccccguccucgucaucuaccaggacaagaaccgccccuccggcauccccgagcgcuucuccggcuccaacuccggcaacaccgccacccucaccaucuccggcacccaggccauggacgaggccgacuacuacugcgccaccuacaccggcuucggcucccucgccgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 15978 - RNA, 1341 nt, Artificial Sequence
  derived and/or modified sequence opt2 from Pidilizumab_HeavyChain1
cagguccagcucguccaguccggcuccgagcucaagaagcccggcgccuccgucaagaucuccugcaaggccuccggcuacaccuucaccaacuacggcaugaacuggguccgccaggcccccggccagggccuccaguggaugggcuggaucaacaccgacuccggcgaguccaccuacgccgaggaguucaagggccgcuucgucuucucccucgacaccuccgucaacaccgccuaccuccagaucaccucccucaccgccgaggacaccggcauguacuucugcguccgcgucggcuacgacgcccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15979 - RNA, 639 nt, Artificial Sequence
  derived and/or modified sequence opt2 from Pidilizumab_LightChain1
gagaucguccucacccagucccccuccucccucuccgccuccgucggcgaccgcgucaccaucaccugcuccgcccgcuccuccgucuccuacaugcacugguuccagcagaagcccggcaaggcccccaagcucuggaucuaccgcaccuccaaccucgccuccggcguccccucccgcuucuccggcuccggcuccggcaccuccuacugccucaccaucaacucccuccagcccgaggacuucgccaccuacuacugccagcagcgcuccuccuucccccucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15980 - RNA, 1350 nt, Artificial Sequence
  derived and/or modified sequence opt2 from Pinatuzumab_vedotin_HeavyChain1
gagguccagcucgucgaguccggcggcggccucguccagcccggcggcucccuccgccucuccugcgccgccuccggcuacgaguucucccgcuccuggaugaacuggguccgccaggcccccggcaagggccucgagugggucggccgcaucuaccccggcgacggcgacaccaacuacuccggcaaguucaagggccgcuucaccaucuccgccgacaccuccaagaacaccgccuaccuccagaugaacucccuccgcgccgaggacaccgccgucuacuacugcgcccgcgacggcuccuccugggacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15981 - RNA, 657 nt, Artificial Sequence
  derived and/or modified sequence opt2 from Pinatuzumab_vedotin_LightChain1
gacauccagaugacccagucccccuccucccucuccgccuccgucggcgaccgcgucaccaucaccugccgcuccucccaguccaucguccacuccgucggcaacaccuuccucgagugguaccagcagaagcccggcaaggcccccaagcuccucaucuacaaggucuccaaccgcuucuccggcguccccucccgcuucuccggcuccggcuccggcaccgacuucacccucaccaucuccucccuccagcccgaggacuucgccaccuacuacugcuuccagggcucccaguuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15982 - RNA, 1023 nt, Artificial Sequence
  derived and/or modified sequence opt2 from Placulumab_chain1
gacauccagaugacccagucccccuccucccucuccgccuccgucggcgaccgcgucaccaucaccugccgcgccucccaggccaucgacuccuaccuccacugguaccagcagaagcccggcaaggcccccaagcuccucaucuacuccgccuccaaccucgagaccggcguccccucccgcuucuccggcuccggcuccggcaccgacuucacccucaccaucuccucccuccuccccgaggacuucgccaccuacuacugccagcaggucgucuggcgccccuucaccuucggccagggcaccaaggucgagaucaagcgcgucgagcccaaguccuccgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15983 - RNA, 1023 nt, Artificial Sequence; identical to SEQ ID NO: 15982
  derived and/or modified sequence opt2 from Placulumab_HeavyChain1

SEQ ID NO: 15984 - RNA, 1341 nt, Artificial Sequence
  derived and/or modified sequence opt2 from Plozalizumab_HeavyChain1
gagguccagcucgucgaguccggcggcggccucgucaagcccggcggcucccuccgccucuccugcgccgccuccggcuucaccuucuccgccuacgccaugaacuggguccgccaggcccccggcaagggccucgagugggucggccgcauccgcaccaagaacaacaacuacgccaccuacuacgccgacuccgucaaggaccgcuucaccaucucccgcgacgacuccaagaacacccucuaccuccagaugaacucccucaagaccgaggacaccgccgucuacuacugcaccaccuucuacggcaacggcgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15985 - RNA, 657 nt, Artificial Sequence
  derived and/or modified sequence opt2 from Plozalizumab_LightChain1
gacgucgucaugacccaguccccccucucccuccccgucacccucggccagcccgccuccaucuccugcaaguccucccagucccuccucgacuccgacggcaagaccuuccucaacugguuccagcagcgccccggccaguccccccgccgccucaucuaccucgucuccaagcucgacuccggcguccccgaccgcuucuccggcuccggcuccggcaccgacuucacccucaagaucucccgcgucgaggccgaggacgucggcgucuacuacugcuggcagggcacccacuuccccuacaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15986 - RNA, 1341 nt, Artificial Sequence
  derived and/or modified sequence opt2 from Pogalizumab_HeavyChain1
gagguccagcucguccaguccggcgccgaggucaagaagcccggcgccuccgucaaggucuccugcaaggccuccggcuacaccuucaccgacuccuacauguccuggguccgccaggcccccggccagggccucgaguggaucggcgacauguaccccgacaacggcgacuccuccuacaaccagaaguuccgcgagcgcgucaccaucacccgcgacaccuccaccuccaccgccuaccucgagcucuccucccuccgcuccgaggacaccgccgucuacuacugcguccucgccccccgcugguacuucuccgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15987 - RNA, 642 nt, Artificial Sequence
  derived and/or modified sequence opt2 from Pogalizumab_LightChain1
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccgcuccggcguccccucccgcuucuccggcuccggcuccggcaccgacuucacccucaccaucuccucccuccagcccgaggacuucgccaccuacuacugccagcagggccacacccucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15988 - RNA, 1341 nt, Artificial Sequence
  derived and/or modified sequence opt2 from Polatuzumab_vedotin_HeavyChain1
gagguccagcucgucgaguccggcggcggccucguccagcccggcggcucccuccgccucuccugcgccgccuccggcuacaccuucuccuccuacuggaucgaguggguccgccaggcccccggcaagggccucgaguggaucggcgagauccuccccggcggcggcgacaccaacuacaacgagaucuucaagggccgcgccaccuucuccgccgacaccuccaagaacaccgccuaccuccagaugaacucccuccgcgccgaggacaccgccgucuacuacugcacccgccgcguccccauccgccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15989 - RNA, 654 nt, Artificial Sequence
  derived and/or modified sequence opt2 from Polatuzumab_vedotin_LightChain1
gacauccagcucacccagucccccuccucccucuccgccuccgucggcgaccgcgucaccaucaccugcaaggccucccaguccgucgacuacgagggcgacuccuuccucaacugguaccagcagaagcccggcaaggcccccaagcuccucaucuacgccgccuccaaccucgaguccggcguccccucccgcuucuccggcuccggcuccggcaccgacuucacccucaccaucuccucccuccagcccgaggacuucgccaccuacuacugccagcaguccaacgaggacccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15990 - RNA, 1326 nt, Artificial Sequence
  derived and/or modified sequence opt2 from Ponezumab_HeavyChain1
cagguccagcucguccaguccggcgccgaggucaagaagcccggcgccuccgucaaggucuccugcaaggccuccggcuacuacaccgaggccuacuacauccacuggguccgccaggcccccggccagggccucgaguggaugggccgcaucgaccccgccaccggcaacaccaaguacgccccccgccuccaggaccgcgucaccaugacccgcgacaccuccaccuccaccgucuacauggagcucuccucccuccgcuccgaggacaccgccgucuacuacugcgccucccucuacucccuccccgucuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15991 - RNA, 657 nt, Artificial Sequence
  derived and/or modified sequence opt2 from Ponezumab_LightChain1
gacgucgucaugacccaguccccccucucccuccccgucacccucggccagcccgccuccaucuccugcaaguccucccagucccuccucuacuccgacgccaagaccuaccucaacugguuccagcagcgccccggccaguccccccgccgccucaucuaccagaucucccgccucgaccccggcguccccgaccgcuucuccggcuccggcuccggcaccgacuucacccucaagaucucccgcgucgaggccgaggacgucggcgucuacuacugccuccagggcacccacuaccccguccucuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15992 - RNA, 1362 nt, Artificial Sequence
  derived and/or modified sequence opt2 from Pritoxaximab_HeavyChain1
cagguccagcuccaggaguccggcgccgagcucguccgcuccggcgccuccguccgcauguccugcaaggccuccggcuacaccuucaccuccuacaacaugcacugggucaagcagacccccggccagggccucgaguggaucggcuacaucuaccccggcaacggcggcaccaacuacauccagaaguucaagggcaaggccauccucaccgccgacaccuccuccuccaccgccuacaugcagaucuccucccucaccuccgaggacuccgccgucuacuucugcacccgcucccccucccacuacuccuccgaccccuacuucgacuacuggggccagggcaccacccucaccgucuccuccgaguucgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15993 - RNA, 642 nt, Artificial Sequence
  derived and/or modified sequence opt2 from Pritoxaximab_LightChain1
gacaucgucaugucccagucccacaaguucauguccaccuccgucggcgaccgcgucuccaucaccugcaaggccucccaggacgucggcaccgccgucgccugguaccagcagaaccccggccagucccccaaguuccucaucuacugggccuccacccgccacaccggcguccccgaccgcuucaccggcuccggcuccggcaccgacuucacccucaccaucaccaacguccaguccgaggaccucgccgacuacuucugccagcaguacuccuccuacccccucaccuucggcgccggcaccucccucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15994 - RNA, 1350 nt, Artificial Sequence
  derived and/or modified sequence opt2 from Pritumumab_HeavyChain1
gagguccagcuccucgaguccggcggcgaccucguccagcccggcggcucccuccgccucuccugcgccgccuccggcuucaccuucuccaacuacgccauguccuggguccgccaggcccccggcaagggccucgagugggucuccgccaucacccccuccggcggcuccaccaacuacgccgacuccgucaagggccgcuucaccaucucccgcgacaacucccagaacacccucuaccuccagaugaacucccuccgcgucgaggacaccgccgucuacaucugcggccgcguccccuaccgcuccaccugguacccccucuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15995 - RNA, 642 nt, Artificial Sequence
  derived and/or modified sequence opt2 from Pritumumab_LightChain1
gacauccagaugacccagucccccuccucccucuccgccuccgucggcgaccgcgucaccaucaccugccgcgccucccaggacaucuccaacuaccucgccugguuccagcagaagcccggcaaggcccccaagucccucaucuacgccgccuccucccuccacuccaagguccccacccaguucuccggcuccggcuccggcaccgacuucacccucaccaucuccucccuccagcccgaggacuucgccaccuacuacugccuccaguacuccaccuaccccaucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15996 - RNA, 1341 nt, Artificial Sequence
  derived and/or modified sequence opt2 from Quilizumab_HeavyChain1
gagguccagcucgucgaguccggcggcggccucguccagcccggcggcucccuccgccucuccugcgccgccuccggcuucaccuucuccgacuacggcaucgccuggguccgccaggcccccggcaagggccucgagugggucgccuucaucuccgaccucgccuacaccaucuacuacgccgacaccgucaccggccgcuucaccaucucccgcgacaacuccaagaacacccucuaccuccagaugaacucccuccgcgccgaggacaccgccgucuacuacugcgcccgcgacaacugggacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 15997 - RNA, 657 nt, Artificial Sequence
  derived and/or modified sequence opt2 from Quilizumab_LightChain1
gacauccagaugacccagucccccuccucccucuccgccuccgucggcgaccgcgucaccaucaccugccgcuccucccagucccucguccacaacaacgccaacaccuaccuccacugguaccagcagaagcccggcaaggcccccaagcuccucaucuacaaggucuccaaccgcuucuccggcguccccucccgcuucuccggcuccggcuccggcaccgacuucacccucaccaucuccucccuccagcccgaggacuucgccaccuacuacugcucccagaacacccucguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 15998 - RNA, 1335 nt, Artificial Sequence
  derived and/or modified sequence opt2 from Racotumomab_HeavyChain1
cagguccagcuccagcaguccggcgccgagcucgucaagcccggcgccuccgucaagcucuccugcaaggccuccggcuacaccuucaccuccuacgacaucaacuggguccgccagcgccccgagcagggccucgaguggaucggcuggaucuuccccggcgacggcuccaccaaguacaacgagaaguucaagggcaaggccacccucaccaccgacaaguccuccuccaccgccuacaugcagcucucccgccucaccuccgaggacuccgccgucuacuucugcgcccgcgaggacuacuacgacaacuccuacuacuucgacuacuggggccagggcaccacccucaccgucuccuccgccaagaccaccccccccuccgucuacccccucgcccccggcuccgccgcccagaccaacuccauggucacccucggcugccucgucaagggcuacuuccccgagcccgucaccgucaccuggaacuccggcucccucuccuccggcguccacaccuuccccgccguccuccaguccgaccucuacacccucuccuccuccgucaccguccccuccuccccccgccccuccgagaccgucaccugcaacgucgcccaccccgccuccuccaccaaggucgacaagaagaucgucccccgcgacugcggcugcaagcccugcaucugcaccguccccgaggucuccuccgucuucaucuucccccccaagcccaaggacguccucaccaucacccucacccccaaggucaccugcgucgucgucgacaucuccaaggacgaccccgagguccaguucuccugguucgucgacgacgucgagguccacaccgcccagacccagccccgcgaggagcaguucaacuccaccuuccgcuccgucuccgagcuccccaucaugcaccaggacuggcucaacggcaaggaguucaagugccgcgucaacuccgccgccuuccccgcccccaucgagaagaccaucuccaagaccaagggccgccccaaggccccccaggucuacaccauccccccccccaaggagcagauggccaaggacaaggucucccucaccugcaugaucaccgacuucuuccccgaggacaucaccgucgaguggcaguggaacggccagcccgccgagaacuacaagaacacccagcccaucaugaacaccaacggcuccuacuucgucuacuccaagcucaacguccagaaguccaacugggaggccggcaacaccuucaccugcuccguccuccacgagggccuccacaaccaccacaccgagaagucccucucccacucccccggcaag

SEQ ID NO: 15999 - RNA, 642 nt, Artificial Sequence
  derived and/or modified sequence opt2 from Racotumomab_LightChain1
gacauccagaugacccagaccaccuccucccucuccgccucccucggcgaccgcgucaccaucuccugccgcgccucccaggacaucuccaacuaccucaacugguaccagcagaagcccgacggcaccgucaagcuccucaucuacuacaccucccgccuccacuccggcguccccucccgcuucuccggcuccggcuccggcaccgacuacucccucaccaucuccaaccucgagcaggaggacaucgccaccuacuucugccagcagggcaacacccuccccuggaccuucggcggcggcaccaagcucgagaucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 16000 - RNA, 1089 nt, Artificial Sequence; identical to SEQ ID NO: 15938
  derived and/or modified sequence opt2 from Racotumomab_scVH-VH'-VH_chain

SEQ ID NO: 16001 - RNA, 1071 nt, Artificial Sequence
  derived and/or modified sequence opt2 from Radretumab_HeavyChain1
gagguccagcuccucgaguccggcggcggccucguccagcccggcggcucccuccgccucuccugcgccgccuccggcuucaccuucuccuccuucuccauguccuggguccgccaggcccccggcaagggccucgagugggucuccuccaucuccggcuccuccggcaccaccuacuacgccgacuccgucaagggccgcuucaccaucucccgcgacaacuccaagaacacccucuaccuccagaugaacucccuccgcgccgaggacaccgccgucuacuacugcgccaagcccuuccccuacuucgacuacuggggccagggcacccucgucaccgucuccuccggcgacggcuccuccggcggcuccggcggcgccuccgagaucguccucacccagucccccggcacccucucccucucccccggcgagcgcgccacccucuccugccgcgccucccaguccgucuccuccuccuuccucgccugguaccagcagaagcccggccaggccccccgccuccucaucuacuacgccuccucccgcgccaccggcauccccgaccgcuucuccggcuccggcuccggcaccgacuucacccucaccaucucccgccucgagcccgaggacuucgccgucuacuacugccagcagaccggccgcaucccccccaccuucggccagggcaccaaggucgagaucaaguccggcggcuccggcggcccccgcgccgcccccgaggucuacgccuucgccacccccgaguggcccggcucccgcgacaagcgcacccucgccugccucauccagaacuucaugcccgaggacaucuccguccaguggcuccacaacgagguccagcuccccgacgcccgccacuccaccacccagccccgcaagaccaagggcuccggcuucuucgucuucucccgccucgaggucacccgcgccgagugggagcagaaggacgaguucaucugccgcgccguccacgaggccgccucccccucccagaccguccagcgcgccgucuccgucaaccccgaguccucccgccgcggcggcugc

SEQ ID NO: 16002 - RNA, 414 nt, Artificial Sequence; identical to SEQ ID NO: 15953
  derived and/or modified sequence opt2 from Radretumab_j_chain

SEQ ID NO: 16003 - RNA, 1368 nt, Artificial Sequence
  derived and/or modified sequence opt2 from Rafivirumab_HeavyChain1
cagguccagcucguccaguccggcgccgaggucaagaagcccggcuccuccgucaaggucuccugcaaggccuccggcggcaccuucaaccgcuacaccgucaacuggguccgccaggcccccggccagggccucgaguggaugggcggcaucauccccaucuucggcaccgccaacuacgcccagcgcuuccagggccgccucaccaucaccgccgacgaguccaccuccaccgccuacauggagcucuccucccuccgcuccgacgacaccgccgucuacuucugcgcccgcgagaaccucgacaacuccggcaccuacuacuacuucuccggcugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16004 - RNA, 1368 nt, Artificial Sequence
  derived and/or modified sequence opt2 from Rafivirumab_HeavyChain
gagguccagcucguccaguccggcgccgaggucaagaagcccggcuccuccgucaaggucuccugcaaggccuccggcggcaccuucaaccgcuacaccgucaacuggguccgccaggcccccggccagggccucgaguggaugggcggcaucauccccaucuucggcaccgccaacuacgcccagcgcuuccagggccgccucaccaucaccgccgacgaguccaccuccaccgccuacauggagcucuccucccuccgcuccgacgacaccgccgucuacuucugcgcccgcgagaaccucgacaacuccggcaccuacuacuacuucuccggcugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16005 - RNA, 654 nt, Artificial Sequence
  derived and/or modified sequence opt2 from Rafivirumab_LightChain1
caguccgcccucacccagccccgcuccgucuccggcucccccggccaguccgucaccaucuccugcaccggcaccuccuccgacaucggcggcuacaacuucgucuccugguaccagcagcaccccggcaaggcccccaagcucaugaucuacgacgccaccaagcgccccuccggcguccccgaccgcuucuccggcuccaaguccggcaacaccgccucccucaccaucuccggccuccaggccgaggacgaggccgacuacuacugcugcuccuacgccggcgacuacacccccggcgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16006 - RNA, 654 nt, Artificial Sequence
  derived and/or modified sequence opt2 from Rafivirumab_LightChain
gaguccgcccucacccagccccgcuccgucuccggcucccccggccaguccgucaccaucuccugcaccggcaccuccuccgacaucggcggcuacaacuucgucuccugguaccagcagcaccccggcaaggcccccaagcucaugaucuacgacgccaccaagcgccccuccggcguccccgaccgcuucuccggcuccaaguccggcaacaccgccucccucaccaucuccggccuccaggccgaggacgaggccgacuacuacugcugcuccuacgccggcgacuacacccccggcgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16007 - RNA, 1332 nt, Artificial Sequence
  derived and/or modified sequence opt2 from Ralpancizumab_HeavyChain1
cagguccagcucguccaguccggcgccgaggucaagaagcccggcgccuccgucaaggucuccugcaaggccuccggcuacaccuucaccuccuacuacaugcacuggguccgccaggcccccggccagggccucgaguggaugggcgagauccaccccuccggcggccgcaccaacuacaacgagaaguucaagucccgcgucaccaugacccgcgacaccuccaccuccaccgucuacauggagcucuccucccuccgcuccgaggacaccgccgucuacuacugcgcccgcgagcgcccccucuacgccuccgaccucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16008 - RNA, 642 nt, Artificial Sequence
  derived and/or modified sequence opt2 from Ralpancizumab_LightChain1
gacauccagaugacccagucccccuccucccucuccgccuccgucggcgaccgcgucaccaucaccugcaaggccucccaggacguccacaccgccgucgccugguaccagcagaagcccggcaaggcccccaagcuccucaucuaccacgccuccuaccgcuacaccggcguccccucccgcuucuccggcuccggcuccggcaccgacuucaccuucaccaucuccucccuccagcccgaggacaucgccaccuacuacugccagcagcgcuacucccucuggcgcaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16009 - RNA, 1338 nt, Artificial Sequence
  derived and/or modified sequence opt2 from Ramucirumab_HeavyChain1
gagguccagcucguccaguccggcggcggccucgucaagcccggcggcucccuccgccucuccugcgccgccuccggcuucaccuucuccuccuacuccaugaacuggguccgccaggcccccggcaagggccucgagugggucuccuccaucuccuccuccuccuccuacaucuacuacgccgacuccgucaagggccgcuucaccaucucccgcgacaacgccaagaacucccucuaccuccagaugaacucccuccgcgccgaggacaccgccgucuacuacugcgcccgcgucaccgacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16010 - RNA, 642 nt, Artificial Sequence
  derived and/or modified sequence opt2 from Ramucirumab_LightChain1
gacauccagaugacccagucccccuccuccgucuccgccuccaucggcgaccgcgucaccaucaccugccgcgccucccagggcaucgacaacuggcucggcugguaccagcagaagcccggcaaggcccccaagcuccucaucuacgacgccuccaaccucgacaccggcguccccucccgcuucuccggcuccggcuccggcaccuacuucacccucaccaucuccucccuccaggccgaggacuucgccgucuacuucugccagcaggccaaggccuucccccccaccuucggcggcggcaccaaggucgacaucaagggcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16011 - RNA, 687 nt, Artificial Sequence
  derived and/or modified sequence opt2 from Ranibiziuab_HeavyChain1
gagguccagcucgucgaguccggcggcggccucguccagcccggcggcucccuccgccucuccugcgccgccuccggcuacgacuucacccacuacggcaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaacucccuccgcgccgaggacaccgccgucuacuacugcgccaaguaccccuacuacuacggcaccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccaccuc

SEQ ID NO: 16012 - RNA, 642 nt, Artificial Sequence
  derived and/or modified sequence opt2 from Ranibiziuab_LightChain1
gacauccagcucacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16013 - RNA, 639 nt, Artificial Sequence
  derived and/or modified sequence opt2 from Ranibizumab_fab_fragment
gacauccagcucacccagucccccuccucccucuccgccuccgucggcgaccgcgucaccaucaccugcuccgccucccaggacaucuccaacuaccucaacugguaccagcagaagcccggcaaggcccccaagguccucaucuacuucaccuccucccuccacuccggcguccccucccgcuucuccggcuccggcuccggcaccgacuucacccucaccaucuccucccuccagcccgaggacuucgccaccuacuacugccagcaguacuccaccguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgag

SEQ ID NO: 16014 - RNA, 693 nt, Artificial Sequence
  derived and/or modified sequence opt2 from Ranibizumab_HeavyChain
gagguccagcucgucgaguccggcggcggccucguccagcccggcggcucccuccgccucuccugcgccgccuccggcuacgacuucacccacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguaccccuacuacuacggcaccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccaccuc

SEQ ID NO: 16015 - RNA, 654 nt, Artificial Sequence
  derived and/or modified sequence opt2 from Ranibizumab_LightChain
gagguccagcucgucgaguccggcggcggccucguccagcccggcggcucccuccgccucuccugcgccgccuccggcuacgacuucacccacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguaccccuacuacuacggcaccucccacugguacuucgacgucuggggccagggcacccucgucaccgucuccuccgccuccaccaagggccccuccgucuucccccucgcccccuccggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 16016 - RNA, 642 nt, Artificial Sequence; identical to SEQ ID NO: 16012
  derived and/or modified sequence opt2 from Ranibizumab_LightChain_variant

SEQ ID NO: 16017 - RNA, 1368 nt, Artificial Sequence
  derived and/or modified sequence opt2 from Refanezumab_HeavyChain1
cagguccagcucguccaguccggcuccgagcucaagaagcccggcgccuccgucaaggucuccugcaaggccuccggcuacaccuucaccaacuacggcaugaacuggguccgccaggcccccggccagggccucgaguggaugggcuggaucaacaccuacaccggcgagcccaccuacgccgacgacuucaccggccgcuucgucuucucccucgacaccuccgucuccaccgccuaccuccagaucuccucccucaaggccgaggacaccgccgucuacuacugcgcccgcaaccccaucaacuacuacggcaucaacuacgagggcuacgucauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16018 - RNA, 657 nt, Artificial Sequence
  derived and/or modified sequence opt2 from Refanezumab_LightChain1
gacaucgucaugacccagucccccgacucccucgccgucucccucggcgagcgcgccaccaucaacugcaaguccucccacuccguccucuacuccuccaaccagaagaacuaccucgccugguaccagcagaagcccggccagccccccaagcuccucaucuacugggccuccacccgcgaguccggcguccccgaccgcuucuccggcuccggcuccggcaccgacuucacccucaccaucuccucccuccaggccgaggacgucgccgucuacuacugccaccaguaccucuccucccucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16019 - RNA, 1314 nt, Artificial Sequence
  derived and/or modified sequence opt2 from REGN2810_HeavyChain1
gagguccagcuccucgaguccggcggcguccucguccagcccggcggcucccuccgccucuccugcgccgccuccggcuucaccuucuccaacuucggcaccuggguccgccaggcccccggcaagggccucgagugggucuccggcaucuccggcggcggccgcgacaccuacuucgccgacuccgucaagggccgcuucaccaucucccgcgacaacuccaagaacacccucuaccuccagaacucccucaagggcgaggacaccgccgucuacuacugcgucaaguggggcaacaucuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccguccacgaggcccuccacaaccacuacacccagaagucccucucccucucccucggc

SEQ ID NO: 16020 - RNA, 639 nt, Artificial Sequence
  derived and/or modified sequence opt2 from REGN2810_LightChain1
gacauccagacccagucccccuccucccucuccgccuccgucggcgacuccaucaccaucaccugccgcgccucccucuccaucaacaccuuccucaacugguaccagcagaagcccggcaaggcccccaaccuccucaucuacgccgccuccucccuccacggcggcguccccucccgcuucuccggcuccggcuccggcaccgacuucacccucaccauccgcacccuccagcccgaggacuucgccaccuacuacugccagcaguccuccaacacccccuucaccuucggccccggcaccgucgucgacuuccgccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16021 - RNA, 651 nt, Artificial Sequence
  derived and/or modified sequence opt2 from rhuMab_HER2(9CI)_LightChain
guccacuccgacauccagaugacccagucccccuccucccucuccgccuccgucggcgaccgcgucaccaucaccugcaaggccucccaggacgucuccaucggcgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcaguacuacaucuaccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16022 - RNA, 1215 nt, Artificial Sequence
  derived and/or modified sequence opt2 from rhuMab_HER2_HeavyChain
gagguccagcucgucgaguccggcggcggccucguccagcccggcggcucccuccgccucuccugcgccgccuccggcuucaccuucaccgacuacaccauggacuggguccgccaggcccccggcaagggccucaccgccgucuacuacugcgcccgcaaccucggccccuccuucuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggccccaag

SEQ ID NO: 16023 - RNA, 645 nt, Artificial Sequence
  derived and/or modified sequence opt2 from rhuMab_HER2_LightChain
uccgacauccagaugacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16024 - RNA, 318 nt, Artificial Sequence
  derived and/or modified sequence opt2 from rhuMab_HER2_LightChain_variant1
accgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16025 - RNA, 642 nt, Artificial Sequence
  derived and/or modified sequence opt2 from rhuMab_HER2_LightChain_variant2
gacauccagaugacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaagcgcaccugcgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16026 - RNA, 642 nt, Artificial Sequence
  derived and/or modified sequence opt2 from rhuMab_HER2_LightChain_variant3
gacauccagaugacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16027 - RNA, 645 nt, Artificial Sequence; identical to SEQ ID NO: 16023
  derived and/or modified sequence opt2 from rhuMab_HER2_LightChain_variant4

SEQ ID NO: 16028 - RNA, 321 nt, Artificial Sequence
  derived and/or modified sequence opt2 from rhuMab_HER2_LightChain_V-Region
gacauccagaugacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaag

SEQ ID NO: 16029 - RNA, 1350 nt, Artificial Sequence
  derived and/or modified sequence opt2 from rhuMab_HER2_gamma1-Chain
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16030 - RNA, 1350 nt, Artificial Sequence
  derived and/or modified sequence opt2 from rhuMab_HER2__gamma1-Chain
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccugcuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16031 - RNA, 729 nt, Artificial Sequence
  derived and/or modified sequence opt2 from rhuMab_HER2_gamma1-Chain__rhuMab_HER2_LightChain_sc4D5
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccggcggcggcggcuccggcggcggcggcuccggcggcggcggcuccgacauccagaugacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaagcgc

SEQ ID NO: 16032 - RNA, 1350 nt, Artificial Sequence; identical to SEQ ID NO: 16029
  derived and/or modified sequence opt2 from rhuMab_HER2_gamma1-Chain_variant1

SEQ ID NO: 16033 - RNA, 1350 nt, Artificial Sequence; identical to SEQ ID NO: 16030
  derived and/or modified sequence opt2 from rhuMab_HER2_gamma1-Chain_variant2

SEQ ID NO: 16034 - RNA, 1350 nt, Artificial Sequence
  derived and/or modified sequence opt2 from rhuMab_HER2_gamma1-Chain_variant3
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcugcgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16035 - RNA, 360 nt, Artificial Sequence
  derived and/or modified sequence opt2 from rhuMab_HER2_gamma1-Chain_V-Region
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccucc

SEQ ID NO: 16036 - RNA, 1359 nt, Artificial Sequence; identical to SEQ ID NO: 15367
  derived and/or modified sequence opt2 from rhuMAb-VEGF_HeavyChain1

SEQ ID NO: 16037 - RNA, 642 nt, Artificial Sequence; identical to SEQ ID NO: 15368
  derived and/or modified sequence opt2 from rhuMAb-VEGF_LightChain1

SEQ ID NO: 16038 - RNA, 642 nt, Artificial Sequence; identical to SEQ ID NO: 15368
  derived and/or modified sequence opt2 from rhuMAb-VEGF_LightChain

SEQ ID NO: 16039 - RNA, 321 nt, Artificial Sequence; identical to SEQ ID NO: 15377
  derived and/or modified sequence opt2 from rhuMAb-VEGF_LightChain__VG-Region

SEQ ID NO: 16040 - RNA, 1359 nt, Artificial Sequence; identical to SEQ ID NO: 15367
  derived and/or modified sequence opt2 from rhuMAb-VEGF_gamma1-Chain

SEQ ID NO: 16041 - RNA, 369 nt, Artificial Sequence; identical to SEQ ID NO: 15372
  derived and/or modified sequence opt2 from rhuMAb-VEGF_gamma1-Chain_VDG-Region

SEQ ID NO: 16042 - RNA, 1338 nt, Artificial Sequence
  derived and/or modified sequence opt2 from Rilotumumab_HeavyChain1
cagguccagcuccaggaguccggccccggccucgucaagcccuccgagacccucucccucaccugcaccgucuccggcggcuccaucuccaucuacuacugguccuggauccgccagccccccggcaagggccucgaguggaucggcuacgucuacuacuccggcuccaccaacuacaaccccucccucaagucccgcgucaccaucuccgucgacaccuccaagaaccaguucucccucaagcucaacuccgucaccgccgccgacaccgccgucuacuacugcgcccgcggcggcuacgacuucugguccggcuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16043 - RNA, 645 nt, Artificial Sequence
  derived and/or modified sequence opt2 from Rilotumumab_LightChain1
gagaucgucaugacccagucccccgccacccucuccgucucccccggcgagcgcgccacccucuccugccgcgccucccaguccgucgacuccaaccucgccugguaccgccagaagcccggccaggccccccgccuccucaucuacggcgccuccacccgcgccaccggcauccccgcccgcuucuccggcuccggcuccggcaccgaguucacccucaccaucuccucccuccaguccgaggacuucgccgucuacuacugccagcaguacaucaacuggccccccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16044 - RNA, 1071 nt, Artificial Sequence; identical to SEQ ID NO: 16001
  derived and/or modified sequence opt2 from Rilotumumab_scFv-CH_chain

SEQ ID NO: 16045 - RNA, 1347 nt, Artificial Sequence
  derived and/or modified sequence opt2 from Rinucumab_HeavyChain1
cagcuccagcuccaggaguccggccccggccucgucaagcccuccgagacccucucccucaccugcaccgucuccggcggcuccaucaccuccuccuccuacuacuggggcuggauccgccagccccccggcaagggccucgaguggaucggcuccaucuacuaccgcggcuccaccaacuacaaccccucccucaagucccgcgucaccaucuccgucgacuccuccaagaaccaguucuaccucaaggucuccuccgucaccgccgucgacaccgccgucuacuacugcgcccgccagaacggcgccgcccgccccuccugguucgaccccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16046 - RNA, 1344 nt, Artificial Sequence
  derived and/or modified sequence opt2 from Rinucumab_HeavyChain
cagcuccagcuccaggaguccggccccggccucgucaagcccuccgagacccucucccucaccugcaccgucuccggcggcuccaucaccuccuccuccuacuacuggggcuggauccgccagccccccggcaagggccucgaguggaucggcuccaucuacuaccgcggcuccaccaacuacaaccccucccucaagucccgcgucaccaucuccgucgacuccuccaagaaccaguucuaccucaaggucuccuccgucaccgccgucgacaccgccgucuacuacugcgcccgccagaacggcgccgcccgccccuccugguucgaccccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 16047 - RNA, 645 nt, Artificial Sequence
  derived and/or modified sequence opt2 from Rinucumab_LightChain1
gagaucguccucacccagucccccgacaccaucucccucucccccggcgagcgcgccacccucuccugccgcgccucccaguccaucuccuccaucuaccucgccugguaccagcagaagcccggccaggccccccgccuccucaucuacggcgccuccucccgcgucaccggcauccccgaccgcuucuccgucuccggcuccggcaccgacuucacccucaccaucucccgccucgagcccgaggacuucgccgucuacuacugccagcacuacggcaucucccccuucaccuucggccccggcaccaaggucgacauccgccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16048 - RNA, 1347 nt, Artificial Sequence
  derived and/or modified sequence opt2 from Risankizumab_HeavyChain1
cagguccagcucguccaguccggcgccgaggucaagaagcccggcuccuccgucaaggucuccugcaaggccuccggcuacaccuucaccgaccagaccauccacuggaugcgccaggcccccggccagggccucgaguggaucggcuacaucuacccccgcgacgacucccccaaguacaacgagaacuucaagggcaaggucaccaucaccgccgacaaguccaccuccaccgccuacauggagcucuccucccuccgcuccgaggacaccgccgucuacuacugcgccauccccgaccgcuccggcuacgccugguucaucuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16049 - RNA, 642 nt, Artificial Sequence
  derived and/or modified sequence opt2 from Risankizumab_LightChain1
gacauccagaugacccagucccccuccucccucuccgccuccgucggcgaccgcgucaccaucaccugcaaggccucccgcgacgucgccaucgccgucgccugguaccagcagaagcccggcaagguccccaagcuccucaucuacugggccuccacccgccacaccggcguccccucccgcuucuccggcuccggcucccgcaccgacuucacccucaccaucuccucccuccagcccgaggacgucgccgacuacuucugccaccaguacuccuccuaccccuucaccuucggcuccggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16050 - RNA, 1353 nt, Artificial Sequence
  derived and/or modified sequence opt2 from Rituximab_HeavyChain
cagguccagcuccagcagcccggcgccgagcucgucaagcccggcgccuccgucaagauguccugcaaggccuccggcuacaccuucaccuccuacaacaugcacugggucaagcagacccccggccgcggccucgaguggaucggcgccaucuaccccggcaacggcgacaccuccuacaaccagaaguucaagggcaaggccacccucaccgccgacaaguccuccuccaccgccuacaugcagcucuccucccucaccuccgaggacuccgccgucuacuacugcgcccgcuccaccuacuacggcggcgacugguacuucaacgucuggggcgccggcaccaccgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16051 - RNA, 1353 nt, Artificial Sequence
  derived and/or modified sequence opt2 from Rituximab_HeavyChain_variant
cagguccagcuccagcagcccggcgccgagcucgucaagcccggcgccuccgucaagauguccugcaaggccuccggcuacaccuucaccuccuacaacaugcacugggucaagcagacccccggccgcggccucgaguggaucggcgccaucuaccccggcaacggcgacaccuccuacaaccagaaguucaagggcaaggccacccucaccgccgacaaguccuccuccaccgccuacaugcagcucuccucccucaccuccgaggacuccgccgucuacuacugcgcccgcuccaccuacuacggcggcgacugguacuucaacgucuggggcgccggcaccaccgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16052 - RNA, 639 nt, Artificial Sequence
  derived and/or modified sequence opt2 from Rituximab_LightChain
cagaucguccucucccagucccccgccauccucuccgccucccccggcgagaaggucaccaugaccugccgcgccuccuccuccgucuccuacauccacugguuccagcagaagcccggcuccucccccaagcccuggaucuacgccaccuccaaccucgccuccggcguccccguccgcuucuccggcuccggcuccggcaccuccuacucccucaccaucucccgcgucgaggccgaggacgccgccaccuacuacugccagcaguggaccuccaacccccccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16053 - RNA, 714 nt, Artificial Sequence
  derived and/or modified sequence opt2 from Rivabazumab_pegol_HeavyChain1
gagguccagcucgucgaguccggcggcggcgucguccagcccggccgcucccuccgccucuccugcgccgccuccggcuucaccuucuccaacuaccccaugcacuggguccgccaggcccccggcaagggccucgagugggucgccgucaucuccuacgacggcuccgagaagugguacgccgacuccgucaagggccgcuucaccaucucccgcgacaacuccaagaacacccucuaccucgagaugaacucccuccgccccgaggacaccgccgucuacuacugcgcccgcaaccgcggcgacaucuacuacgacuucaccuacgccauggacaucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccuccgacaagacccacaccugcccccccugccccgcc

SEQ ID NO: 16054 - RNA, 642 nt, Artificial Sequence
  derived and/or modified sequence opt2 from Rivabazumab_pegol_LightChain1
gacauccagcucacccagucccccuccacccucuccgccuccgucggcgacuccgucaccaucaccugccgcgccuccgagggcgucgaccgcuggcucgccugguaccagcagaagcccggccgcgcccccaagcuccucaucuacgacgccuccacccuccaguccggcguccccucccgcuucuccggcuccggcuccggcaccgaguucucccucaccaucuccucccuccagcccgacgacgucgccaccuacuacugccagcacuucuggggcacccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagucc

SEQ ID NO: 16055 - RNA, 1344 nt, Artificial Sequence
  derived and/or modified sequence opt2 from Robatumumab_HeavyChain1
gagguccagcucguccaguccggcggcggccucgucaagcccggcggcucccuccgccucuccugcgccgccuccggcuucaccuucuccuccuucgccaugcacuggguccgccaggcccccggcaagggccucgaguggaucuccgucaucgacacccgcggcgccaccuacuacgccgacuccgucaagggccgcuucaccaucucccgcgacaacgccaagaacucccucuaccuccagaugaacucccuccgcgccgaggacaccgccgucuacuacugcgcccgccucggcaacuucuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16056 - RNA, 642 nt, Artificial Sequence
  derived and/or modified sequence opt2 from Robatumumab_LightChain1
gagaucguccucacccagucccccggcacccucuccgucucccccggcgagcgcgccacccucuccugccgcgccucccaguccaucggcuccucccuccacugguaccagcagaagcccggccaggccccccgccuccucaucaaguacgccucccagucccucuccggcauccccgaccgcuucuccggcuccggcuccggcaccgacuucacccucaccaucucccgccucgagcccgaggacuucgccgucuacuacugccaccaguccucccgccucccccacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16057 - RNA, 1368 nt, Artificial Sequence
  derived and/or modified sequence opt2 from Roledumab_HeavyChain1
cagguccagcucgucgaguccggcggcggcgucguccagcccggccgcucccuccgccucuccugcaccgccuccggcuucaccuucaagaacuacgccaugcacuggguccgccaggcccccgccaagggccucgagugggucgccaccaucuccuacgacggccgcaacauccaguacgccgacuccgucaagggccgcuucaccuucucccgcgacaacucccaggacacccucuaccuccagcucaacucccuccgccccgaggacaccgccgucuacuacugcgcccgccccguccgcucccgcuggcuccagcucggccucgaggacgccuuccacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16058 - RNA, 642 nt, Artificial Sequence
  derived and/or modified sequence opt2 from Roledumab_LightChain1
gccauccgcaugacccagucccccuccuccuucuccgccuccaccggcgaccgcgucaccaucaccugccgcgccucccaggacauccgcaacuacgucgccugguaccagcagaaguccggcaaggcccccaaguuccucaucuacgccgccuccacccuccaguccggcguccccucccgcuucuccggcuccggcuccggcaccgacuucacccucaccaucaacucccuccaguccgaggacuucgccaccuacuacugccagcaguacuacaacuccccccccaccuucggccagggcacccgcgucgagaucacccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16059 - RNA, 639 nt, Artificial Sequence; identical to SEQ ID NO: 16013
  derived and/or modified sequence opt2 from Romosozumab_fab_fragment

SEQ ID NO: 16060 - RNA, 1347 nt, Artificial Sequence
  derived and/or modified sequence opt2 from Romosozumab_HeavyChain1
gagguccagcucguccaguccggcgccgaggucaagaagcccggcgccuccgucaaggucuccugcaaggccuccggcuacaccuucaccgacuacaacaugcacuggguccgccaggcccccggccagggccucgaguggaugggcgagaucaaccccaacuccggcggcgccggcuacaaccagaaguucaagggccgcgucaccaugaccaccgacaccuccaccuccaccgccuacauggagcuccgcucccuccgcuccgacgacaccgccgucuacuacugcgcccgccucggcuacgacgacaucuacgacgacugguacuucgacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16061 - RNA, 642 nt, Artificial Sequence
  derived and/or modified sequence opt2 from Romosozumab_LightChain1
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccucccgccuccucuccggcguccccucccgcuucuccggcuccggcuccggcaccgacuucacccucaccaucuccucccuccagcccgaggacuucgccaccuacuacugccagcagggcgacacccuccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16062 - RNA, 1326 nt, Artificial Sequence
  derived and/or modified sequence opt2 from Rontalizuab_HeavyChain1
gagguccagcucgucgaguccggcggcggccucguccagcccggcggcucccuccgccucuccugcgccaccuccggcuacaccuucaccgaguacaucauccacuggguccgccaggcccccggcaagggccucgagugggucgccuccaucaaccccgacuacgacaucaccaacuacaaccagcgcuucaagggccgcuucaccaucucccucgacaaguccaagcgcaccgccuaccuccagaacucccuccgcgccgaggacaccgccgucuacuacugcgccuccuggaucuccgacuucuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 16063 - RNA, 648 nt, Artificial Sequence
  derived and/or modified sequence opt2 from Rontalizuab_LightChain1
gacauccagacccagucccccuccucccucuccgccuccgucggcgaccgcgucaccaucaccugccgcgccucccaguccgucuccaccuccuccuacuccuaccacugguaccagcagaagcccggcaaggcccccaagguccucaucuccuacgccuccaaccucgaguccggcguccccucccgcuucuccggcuccggcuccggcaccgacuucacccucaccaucuccucccuccagcccgaggacuucgccaccuacuacugccagcacuccuggggcaucccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16064 - RNA, 1341 nt, Artificial Sequence
  derived and/or modified sequence opt2 from Rontalizumab_HeavyChain1
gagguccagcucgucgaguccggcggcggccucguccagcccggcggcucccuccgccucuccugcgccaccuccggcuacaccuucaccgaguacaucauccacuggguccgccaggcccccggcaagggccucgagugggucgccuccaucaaccccgacuacgacaucaccaacuacaaccagcgcuucaagggccgcuucaccaucucccucgacaaguccaagcgcaccgccuaccuccagaugaacucccuccgcgccgaggacaccgccgucuacuacugcgccuccuggaucuccgacuucuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16065 - RNA, 654 nt, Artificial Sequence
  derived and/or modified sequence opt2 from Rontalizumab_LightChain1
gacauccagaugacccagucccccuccucccucuccgccuccgucggcgaccgcgucaccaucaccugccgcgccucccaguccgucuccaccuccuccuacuccuacaugcacugguaccagcagaagcccggcaaggcccccaagguccucaucuccuacgccuccaaccucgaguccggcguccccucccgcuucuccggcuccggcuccggcaccgacuucacccucaccaucuccucccuccagcccgaggacuucgccaccuacuacugccagcacuccuggggcaucccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16066 - RNA, 1341 nt, Artificial Sequence
  derived and/or modified sequence opt2 from Rovalpituzumab_tesirine_HeavyChain1
cagguccagcucguccaguccggcgccgaggucaagaagcccggcgccuccgucaaggucuccugcaaggccuccggcuacaccuucaccaacuacggcaugaacuggguccgccaggcccccggccagggccucgaguggaugggcuggaucaacaccuacaccggcgagcccaccuacgccgacgacuucaagggccgcgucaccaugaccaccgacaccuccaccuccaccgccuacauggagcuccgcucccuccgcuccgacgacaccgccgucuacuacugcgcccgcaucggcgacuccucccccuccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16067 - RNA, 642 nt, Artificial Sequence
  derived and/or modified sequence opt2 from Rovalpituzumab_tesirine_LightChain1
gagaucgucaugacccagucccccgccacccucuccgucucccccggcgagcgcgccacccucuccugcaaggccucccaguccgucuccaacgacgucgucugguaccagcagaagcccggccaggccccccgccuccucaucuacuacgccuccaaccgcuacaccggcauccccgcccgcuucuccggcuccggcuccggcaccgaguucacccucaccaucuccucccuccaguccgaggacuucgccgucuacuacugccagcaggacuacaccucccccuggaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16068 - RNA, 1341 nt, Artificial Sequence
  derived and/or modified sequence opt2 from Rovelizumab_HeavyChain1
cagguccagcucguccaguccggcgccgaggucaagaagcccggcgccuccgucaaggucuccugcaaggccuccggcuacaccuucaccaacaacuggaugcaguggguccgccaggcccccggccagggccucgaguggaugggcgccaucuuccccggcgacgacgagacccgcuacacccagaaguuccgcggcaaggccaccaucaccgccgacaccuccaccuccaccgccuacauggagcucuccucccuccgcuccgaggacaccgccgucuacuacugcggccgcggcggcaagcuccgccccuucgcccucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16069 - RNA, 654 nt, Artificial Sequence
  derived and/or modified sequence opt2 from Rovelizumab_LightChain1
gacauccagaugacccagucccccuccucccucuccgccuccgucggcgaccgcgucaccaucaccugccgcgccuccgaguccgucgaguccuacggcaacaacuucauguacugguaccagcagaagcccggcaaggcccccaagcuccucaucuaccucgccuccaaccucgaguccggcguccccucccgcuucuccggcuccggcuccggcaccgacuucacccucaccaucuccucccuccagcccgaggacuucgccaccuacuacugccaccaggacaacgaggacccccccaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16070 - RNA, 1341 nt, Artificial Sequence
  derived and/or modified sequence opt2 from Ruplizumab_HeavyChain1
cagguccagcucguccaguccggcgccgaggucgucaagcccggcgccuccgucaagcucuccugcaaggccuccggcuacaucuucaccuccuacuacauguacugggucaagcaggcccccggccagggccucgaguggaucggcgagaucaaccccuccaacggcgacaccaacuucaacgagaaguucaaguccaaggccacccucaccgucgacaaguccgccuccaccgccuacauggagcucuccucccuccgcuccgaggacaccgccgucuacuacugcacccgcuccgacggccgcaacgacauggacuccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16071 - RNA, 654 nt, Artificial Sequence
  derived and/or modified sequence opt2 from Ruplizumab_LightChain1
gacaucguccucacccagucccccgccacccucuccgucucccccggcgagcgcgccaccaucuccugccgcgccucccagcgcgucuccuccuccaccuacuccuacaugcacugguaccagcagaagcccggccagccccccaagcuccucaucaaguacgccuccaaccucgaguccggcguccccgcccgcuucuccggcuccggcuccggcaccgacuucacccucaccaucuccuccgucgagcccgaggacuucgccaccuacuacugccagcacuccugggagaucccccccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16072 - RNA, 1353 nt, Artificial Sequence
  derived and/or modified sequence opt2 from Sacituzumab_govitecan_HeavyChain1
cagguccagcuccagcaguccggcuccgagcucaagaagcccggcgccuccgucaaggucuccugcaaggccuccggcuacaccuucaccaacuacggcaugaacugggucaagcaggcccccggccagggccucaaguggaugggcuggaucaacaccuacaccggcgagcccaccuacaccgacgacuucaagggccgcuucgccuucucccucgacaccuccgucuccaccgccuaccuccagaucuccucccucaaggccgacgacaccgccgucuacuucugcgcccgcggcggcuucggcuccuccuacugguacuucgacgucuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16073 - RNA, 642 nt, Artificial Sequence
  derived and/or modified sequence opt2 from Sacituzumab_govitecan_LightChain1
gacauccagcucacccagucccccuccucccucuccgccuccgucggcgaccgcgucuccaucaccugcaaggccucccaggacgucuccaucgccgucgccugguaccagcagaagcccggcaaggcccccaagcuccucaucuacuccgccuccuaccgcuacaccggcguccccgaccgcuucuccggcuccggcuccggcaccgacuucacccucaccaucuccucccuccagcccgaggacuucgccgucuacuacugccagcagcacuacaucaccccccucaccuucggcgccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16074 - RNA, 1326 nt, Artificial Sequence
  derived and/or modified sequence opt2 from Samalizumab_HeavyChain1
cagguccagcuccagcaguccggcuccgagcucaagaagcccggcgccuccgucaagaucuccugcaaggccuccggcuacuccuucaccgacuacaucauccucuggguccgccagaaccccggcaagggccucgaguggaucggccacaucgaccccuacuacggcuccuccaacuacaaccucaaguucaagggccgcgucaccaucaccgccgaccaguccaccaccaccgccuacauggagcucuccucccuccgcuccgaggacaccgccgucuacuacugcggccgcuccaagcgcgacuacuucgacuacuggggccagggcaccacccucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 16075 - RNA, 642 nt, Artificial Sequence
  derived and/or modified sequence opt2 from Samalizumab_LightChain1
gacauccagaugacccagucccccuccucccucuccgccuccaucggcgaccgcgucaccaucaccugcaaggccucccaggacaucaacuccuaccucuccugguuccagcagaagcccggcaaggcccccaagcuccucaucuaccgcgccaaccgccucgucgacggcguccccucccgcuucuccggcuccggcuccggcaccgacuacacccucaccaucuccucccuccagcccgaggacuucgccgucuacuacugccuccaguacgacgaguuccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16076 - RNA, 1338 nt, Artificial Sequence
  derived and/or modified sequence opt2 from Sarilumab_HeavyChain1
gagguccagcucgucgaguccggcggcggccucguccagcccggccgcucccuccgccucuccugcgccgccucccgcuucaccuucgacgacuacgccaugcacuggguccgccaggcccccggcaagggccucgagugggucuccggcaucuccuggaacuccggccgcaucggcuacgccgacuccgucaagggccgcuucaccaucucccgcgacaacgccgagaacucccucuuccuccagaugaacggccuccgcgccgaggacaccgcccucuacuacugcgccaagggccgcgacuccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16077 - RNA, 642 nt, Artificial Sequence
  derived and/or modified sequence opt2 from Sarilumab_LightChain1
gacauccagaugacccagucccccuccuccgucuccgccuccgucggcgaccgcgucaccaucaccugccgcgccucccagggcaucuccuccuggcucgccugguaccagcagaagcccggcaaggcccccaagcuccucaucuacggcgccuccucccucgaguccggcguccccucccgcuucuccggcuccggcuccggcaccgacuucacccucaccaucuccucccuccagcccgaggacuucgccuccuacuacugccagcaggccaacuccuuccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16078 - RNA, 1296 nt, Artificial Sequence
  derived and/or modified sequence opt2 from Satumomab_pendetide_HeavyChain
cagguccagcuccagcaguccgacgccgagcucgucaagcccggcgccuccgucaagaucuccugcaaggccuccggcuacaccuucaccgaccacgccauccacugggccaagcagaagcccgagcagggccucgaguggaucggcuacaucucccccggcaacgacgacaucaaguacaacgagaaguucaagggcaaggccacccucaccgccgacaaguccuccuccaccgccuacaugcagcucaacucccucaccuccgaggacuccgccgucuacuucugcaagcgcuccuacuacggccacuggggccagggcaccacccucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucugcccccccugcaagugccccgcccccaaccuccucggcggccccuccgucuucaucuucccccccaagaucaaggacguccucaugaucucccucucccccaucgucaccugcgucgucgucgacgucuccgaggacgaccccgacguccagaucuccugguucgucaacaacgucgagguccacaccgcccagacccagacccaccgcgaggacuacaacuccacccuccgcgucgucuccgcccuccccauccagcaccaggacuggauguccggcaaggaguucaagugcaaggucaacaacaaggaccuccccgcccccaucgagcgcaccaucuccaagcccaagggcuccguccgcgccccccaggucuacguccuccccccccccgaggaggagaugaccaagaagcaggucacccucaccugcauggucaccgacuucaugcccgaggacaucuacgucgaguggaccaacaacggcaagaccgagcucaacuacaagaacaccgagcccguccucgacuccgacggcuccuacuucauguacuccaagcuccgcgucgagaagaagaacugggucgagcgcaacuccuacuccugcuccgucguccacgagggccuccacaaccaccacaccaccaaguccuucucccgc

SEQ ID NO: 16079 - RNA, 630 nt, Artificial Sequence
  derived and/or modified sequence opt2 from Satumomab_pendetide_LightChain
gacauccagaugacccagucccccgccucccucuccgucuccgucggcgagaccgucaccaucaccugccgcgccuccgagaacaucuacuccaaccucgccugguaccagcagaagcagggcaaguccccccagcuccucgucuacgccgccaccaaccucgccgacggcguccccucccgcuucuccggcuccggcuccggcacccaguacucccucaagaucaacucccuccaguccgaggacuucggcuccuacuacugccagcacuucuggggcacccccuacaccuucggcggcggcacccgccucgagaucaagcgcgccgacgccgcccccaccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaac

SEQ ID NO: 16080 - RNA, 1371 nt, Artificial Sequence
  derived and/or modified sequence opt2 from Secukinumab_HeavyChain1
gagguccagcucgucgaguccggcggcggccucguccagcccggcggcucccuccgccucuccugcgccgccuccggcuucaccuucuccaacuacuggaugaacuggguccgccaggcccccggcaagggccucgagugggucgccgccaucaaccaggacggcuccgagaaguacuacgucggcuccgucaagggccgcuucaccaucucccgcgacaacgccaagaacucccucuaccuccagaugaacucccuccgcgucgaggacaccgccgucuacuacugcguccgcgacuacuacgacauccucaccgacuacuacauccacuacugguacuucgaccucuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16081 - RNA, 645 nt, Artificial Sequence
  derived and/or modified sequence opt2 from Secukinumab_LightChain1
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccccugcaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16082 - RNA, 1335 nt, Artificial Sequence
  derived and/or modified sequence opt2 from Seribantumab_HeavyChain1
gagguccagcuccucgaguccggcggcggccucguccagcccggcggcucccuccgccucuccugcgccgccuccggcuucaccuucucccacuacgucauggccuggguccgccaggcccccggcaagggccucgagugggucuccuccaucuccuccuccggcggcuggacccucuacgccgacuccgucaagggccgcuucaccaucucccgcgacaacuccaagaacacccucuaccuccagaugaacucccuccgcgccgaggacaccgccgucuacuacugcacccgcggccucaagauggccaccaucuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16083 - RNA, 651 nt, Artificial Sequence
  derived and/or modified sequence opt2 from Seribantumab_LightChain1
caguccgcccucacccagcccgccuccgucuccggcucccccggccaguccaucaccaucuccugcaccggcaccuccuccgacgucggcuccuacaacgucgucuccugguaccagcagcaccccggcaaggcccccaagcucaucaucuacgaggucucccagcgccccuccggcgucuccaaccgcuucuccggcuccaaguccggcaacaccgccucccucaccaucuccggccuccagaccgaggacgaggccgacuacuacugcugcuccuacgccggcuccuccaucuucgucaucuucggcggcggcaccaaggucaccguccucggccagcccaaggccgcccccuccgucacccucuucccccccuccuccgaggagcuccaggccaacaaggccacccucgucugccucgucuccgacuucuaccccggcgccgucaccgucgccuggaaggccgacggcucccccgucaaggucggcgucgagaccaccaagcccuccaagcaguccaacaacaaguacgccgccuccuccuaccucucccucacccccgagcaguggaagucccaccgcuccuacuccugccgcgucacccacgagggcuccaccgucgagaagaccgucgcccccgccgagugcucc

SEQ ID NO: 16084 - RNA, 1353 nt, Artificial Sequence
  derived and/or modified sequence opt2 from Setoxaximab_HeavyChain1
gagguccagcuccagcagcccggccccgagcucgagaagcccggcgccuccgucaagcucuccugcaaggccuccggcuacuccuucaccgacuacaacaugaacugggucaagcagaacaacggcgagucccucgaguggaucggcaagaucgaccccuacuacggcggccccuccuacaaccagaaguucaaggacaaggccacccucaccgucgacaaguccuccuccaccgccuacaugcagcucaagucccucaccuccgaggacuccgccgucuacuacugcacccgcggcggcaaccgcgacugguacuucgacgucuggggcgccggcaccacccucaccgucuccgccgaguucgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16085 - RNA, 660 nt, Artificial Sequence
  derived and/or modified sequence opt2 from Setoxaximab_LightChain1
gacaucguccucucccagucccccuccucccucgucgucuccgucggcgagaaggucaccauguccugcaaguccucccagucccuccucuacucccgcaaccagaagaacuaccucgccugguaccagcagaagcccggccagucccccaagguccucaucuacugggccuccacccgcgaguccggcguccccgaccgccucaccggcuccggcuccggcaccgacuucacccucaccaucuccuccgucaaggccgaggaccucgccgucuacuacugccagcaguacuacuccuacccccucaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16086 - RNA, 1338 nt, Artificial Sequence
  derived and/or modified sequence opt2 from Sifalimumab_HeavyChain1
cagguccagcucguccaguccggcgccgaggucaagaagcccggcgccuccgucaaggucuccugcaaggccuccggcuacaccuucaccuccuacuccaucuccuggguccgccaggcccccggccagggccucgaguggaugggcuggaucuccgucuacaacggcaacaccaacuacgcccagaaguuccagggccgcgucaccaugaccaccgacaccuccaccuccaccgccuaccucgagcuccgcucccuccgcuccgacgacaccgccgucuacuacugcgcccgcgaccccaucgccgccggcuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16087 - RNA, 645 nt, Artificial Sequence
  derived and/or modified sequence opt2 from Sifalimumab_LightChain1
gagaucguccucacccagucccccggcacccucucccucucccccggcgagcgcgccacccucuccugccgcgccucccaguccgucuccuccaccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccuccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16088 - RNA, 1347 nt, Artificial Sequence
  derived and/or modified sequence opt2 from Siltuximab_HeavyChain1
gagguccagcucgucgaguccggcggcaagcuccucaagcccggcggcucccucaagcucuccugcgccgccuccggcuucaccuucuccuccuucgccauguccugguuccgccagucccccgagaagcgccucgagugggucgccgagaucuccuccggcggcuccuacaccuacuaccccgacaccgucaccggccgcuucaccaucucccgcgacaacgccaagaacacccucuaccucgagauguccucccuccgcuccgaggacaccgccauguacuacugcgcccgcggccucuggggcuacuacgcccucgacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16089 - RNA, 639 nt, Artificial Sequence
  derived and/or modified sequence opt2 from Siltuximab_LightChain1
cagaucguccucauccagucccccgccaucauguccgccucccccggcgagaaggucaccaugaccugcuccgccuccuccuccgucuccuacauguacugguaccagcagaagcccggcuccuccccccgccuccucaucuacgacaccuccaaccucgccuccggcguccccguccgcuucuccggcuccggcuccggcaccuccuacucccucaccaucucccgcauggaggccgaggacgccgccaccuacuacugccagcagugguccggcuaccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16090 - RNA, 1329 nt, Artificial Sequence
  derived and/or modified sequence opt2 from Simtuzumab_HeavyChain1
cagguccagcucguccaguccggcgccgaggucaagaagcccggcgccuccgucaaggucuccugcaaggccuccggcuacgccuucaccuacuaccucaucgaguggguccgccaggcccccggccagggccucgaguggaucggcgucaucaaccccggcuccggcggcaccaacuacaacgagaaguucaagggccgcgccaccaucaccgccgacaaguccaccuccaccgccuacauggagcucuccucccuccgcuccgaggacaccgccgucuacuucugcgcccgcaacuggaugaacuucgacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16091 - RNA, 657 nt, Artificial Sequence
  derived and/or modified sequence opt2 from Simtuzumab_LightChain1
gacaucgucaugacccagaccccccucucccucuccgucacccccggccagcccgccuccaucuccugccgcuccuccaagucccuccuccacuccaacggcaacaccuaccucuacugguuccuccagaagcccggccaguccccccaguuccucaucuaccgcauguccaaccucgccuccggcguccccgaccgcuucuccggcuccggcuccggcaccgacuucacccucaagaucucccgcgucgaggccgaggacgucggcgucuacuacugcaugcagcaccucgaguaccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16092 - RNA, 1347 nt, Artificial Sequence
  derived and/or modified sequence opt2 from Sirukumab_HeavyChain1
gagguccagcucgucgaguccggcggcggccucguccagcccggcggcucccuccgccucuccugcgccgccuccggcuucaccuucucccccuucgccauguccuggguccgccaggcccccggcaagggccucgagugggucgccaagaucucccccggcggcuccuggaccuacuacuccgacaccgucaccggccgcuucaccaucucccgcgacaacgccaagaacucccucuaccuccagaugaacucccuccgcgccgaggacaccgccgucuacuacugcgcccgccagcucuggggcuacuacgcccucgacaucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16093 - RNA, 639 nt, Artificial Sequence
  derived and/or modified sequence opt2 from Sirukumab_LightChain1
gagaucguccucacccagucccccgccacccucucccucucccccggcgagcgcgccacccucuccugcuccgccuccaucuccgucuccuacauguacugguaccagcagaagcccggccaggccccccgccuccucaucuacgacauguccaaccucgccuccggcauccccgcccgcuucuccggcuccggcuccggcaccgacuucacccucaccaucuccucccucgagcccgaggacuucgccgucuacuacugcaugcagugguccggcuaccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16094 - RNA, 1338 nt, Artificial Sequence
  derived and/or modified sequence opt2 from Sofituzumab_vedotin_HeavyChain1
gagguccagcucgucgaguccggcggcggccucguccagcccggcggcucccuccgccucuccugcgccgccuccggcuacuccaucaccaacgacuacgccuggaacuggguccgccaggcccccggcaagggccucgagugggucggcuacaucuccuacuccggcuacaccaccuacaaccccucccucaagucccgcuucaccaucucccgcgacaccuccaagaacacccucuaccuccagaugaacucccuccgcgccgaggacaccgccgucuacuacugcgcccgcuggaccuccggccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16095 - RNA, 642 nt, Artificial Sequence
  derived and/or modified sequence opt2 from Sofituzumab_vedotin_LightChain1
gacauccagaugacccagucccccuccucccucuccgccuccgucggcgaccgcgucaccaucaccugcaaggccuccgaccucauccacaacuggcucgccugguaccagcagaagcccggcaaggcccccaagcuccucaucuacggcgccaccucccucgagaccggcguccccucccgcuucuccggcuccggcuccggcaccgacuucacccucaccaucuccucccuccagcccgaggacuucgccaccuacuacugccagcaguacuggaccacccccuucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16096 - RNA, 1323 nt, Artificial Sequence
  derived and/or modified sequence opt2 from Solanezumab_HeavyChain1
gagguccagcucgucgaguccggcggcggccucguccagcccggcggcucccuccgccucuccugcgccgccuccggcuucaccuucucccgcuacuccauguccuggguccgccaggcccccggcaagggccucgagcucgucgcccagaucaacuccgucggcaacuccaccuacuaccccgacaccgucaagggccgcuucaccaucucccgcgacaacgccaagaacacccucuaccuccagaugaacucccuccgcgccgaggacaccgccgucuacuacugcgccuccggcgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16097 - RNA, 1326 nt, Artificial Sequence
  derived and/or modified sequence opt2 from Solanezumab_HeavyChain
gagguccagcucgucgaguccggcggcggccucguccagcccggcggcucccuccgccucuccugcgccgccuccggcuucaccuucucccgcuacuccauguccuggguccgccaggcccccggcaagggccucgagcucgucgcccagaucaacuccgucggcaacuccaccuacuaccccgacaccgucaagggccgcuucaccaucucccgcgacaacgccaagaacacccucuaccuccagaugaacucccuccgcgccgaggacaccgccgucuacuacugcgccuccggcgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16098 - RNA, 657 nt, Artificial Sequence
  derived and/or modified sequence opt2 from Solanezumab_LightChain1
gacgucgucaugacccaguccccccucucccuccccgucacccucggccagcccgccuccaucuccugccgcuccucccagucccucaucuacuccgacggcaacgccuaccuccacugguuccuccagaagcccggccaguccccccgccuccucaucuacaaggucuccaaccgcuucuccggcguccccgaccgcuucuccggcuccggcuccggcaccgacuucacccucaagaucucccgcgucgaggccgaggacgucggcgucuacuacugcucccaguccacccacguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16099 - RNA, 1506 nt, Artificial Sequence
  derived and/or modified sequence opt2 from Solitomab_HeavyChain1
gagcucgucaugacccagucccccuccucccucaccgucaccgccggcgagaaggucaccauguccugcaaguccucccagucccuccucaacuccggcaaccagaagaacuaccucaccugguaccagcagaagcccggccagccccccaagcuccucaucuacugggccuccacccgcgaguccggcguccccgaccgcuucaccggcuccggcuccggcaccgacuucacccucaccaucuccuccguccaggccgaggaccucgccgucuacuacugccagaacgacuacuccuacccccucaccuucggcgccggcaccaagcucgagaucaagggcggcggcggcuccggcggcggcggcuccggcggcggcggcuccgagguccagcuccucgagcaguccggcgccgagcucguccgccccggcaccuccgucaagaucuccugcaaggccuccggcuacgccuucaccaacuacuggcucggcugggucaagcagcgccccggccacggccucgaguggaucggcgacaucuuccccggcuccggcaacauccacuacaacgagaaguucaagggcaaggccacccucaccgccgacaaguccuccuccaccgccuacaugcagcucuccucccucaccuucgaggacuccgccgucuacuucugcgcccgccuccgcaacugggacgagcccauggacuacuggggccagggcaccaccgucaccgucuccuccggcggcggcggcuccgacguccagcucguccaguccggcgccgaggucaagaagcccggcgccuccgucaaggucuccugcaaggccuccggcuacaccuucacccgcuacaccaugcacuggguccgccaggcccccggccagggccucgaguggaucggcuacaucaaccccucccgcggcuacaccaacuacgccgacuccgucaagggccgcuucaccaucaccaccgacaaguccaccuccaccgccuacauggagcucuccucccuccgcuccgaggacaccgccaccuacuacugcgcccgcuacuacgacgaccacuacugccucgacuacuggggccagggcaccaccgucaccgucuccuccggcgagggcaccuccaccggcuccggcggcuccggcggcuccggcggcgccgacgacaucguccucacccagucccccgccacccucucccucucccccggcgagcgcgccacccucuccugccgcgccucccaguccgucuccuacaugaacugguaccagcagaagcccggcaaggcccccaagcgcuggaucuacgacaccuccaaggucgccuccggcguccccgcccgcuucuccggcuccggcuccggcaccgacuacucccucaccaucaacucccucgaggccgaggacgccgccaccuacuacugccagcagugguccuccaacccccucaccuucggcggcggcaccaaggucgagaucaagcaccaccaccaccaccac

SEQ ID NO: 16100 - RNA, 1506 nt, Artificial Sequence; identical to SEQ ID NO: 16099
  derived and/or modified sequence opt2 from Solitomab_SingleChain

SEQ ID NO: 16101 - RNA, 702 nt, Artificial Sequence
  derived and/or modified sequence opt2 from Sonepcizumab_LightChain_Precursor
auguccguccccacccagguccucggccuccuccuccucuggcucaccgacgcccgcugcgagaccaccgucacccagucccccuccuuccucuccgccuccgucggcgaccgcgucaccaucaccugcaucaccaccaccgacaucgacgacgacaugaacugguuccagcaggagcccggcaaggcccccaagcuccucaucuccgagggcaacauccuccgccccggcguccccucccgcuucuccuccuccggcuacggcaccgacuucacccucaccaucuccaagcuccagcccgaggacuucgccaccuacuacugccuccaguccgacaaccuccccuucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16102 - RNA, 1365 nt, Artificial Sequence
  derived and/or modified sequence opt2 from Sonepcizumab_gamma1-Chain_Precursor
auggagugguccugggucuuccucuucuuccucuccgucaccaccggcguccacuccgagguccagcucguccaguccggcgccgaggucaagaagcccggcgagucccucaagaucuccugccaguccuucggcuacaucuucaucgaccacaccauccacuggaugcgccagaugcccggccagggccucgaguggaugggcgccaucuccccccgccacgacaucaccaaguacaacgagauguuccgcggccaggucaccaucuccgccgacaaguccuccuccaccgccuaccuccagugguccucccucaaggccuccgacaccgccauguacuucugcgcccgcggcggcuucuacggcuccaccaucugguucgacuucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16103 - RNA, 1338 nt, Artificial Sequence
  derived and/or modified sequence opt2 from Stamulumab_HeavyChain1
guccagcucguccaguccggcgccgaggucaagaagcccggcgccuccgucaaggucuccugcaaggccuccggcuacaccuucaccuccuacuacaugcacuggguccgccaggcccccggccagggccucgaguggaugggcaucaucaaccccuccggcggcuccaccuccuacgcccagaaguuccagggccgcgucaccaugacccgcgacaccuccaccuccaccgucuacauggagcucuccucccuccgcuccgaggacaccgccgucuacuacugcgcccgcgacgagaacuggggcuucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16104 - RNA, 633 nt, Artificial Sequence
  derived and/or modified sequence opt2 from Stamulumab_LightChain1
uccuacgagcucacccagccccccuccgucuccgucucccccggccagaccgccuccaucaccugcuccggccacgcccucggcgacaaguucgucuccugguaccagcagaagcccggccagucccccguccucgucaucuacgacgacacccagcgccccuccggcauccccgagcgcuucuccggcuccaacuccggcaacaccgccacccucaccaucuccggcacccaggccauggacgaggccgacuacuacugccaggccugggacuccuccuucgucuucggcggcggcaccaaggucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16105 - RNA, 1356 nt, Artificial Sequence
  derived and/or modified sequence opt2 from Suptavumab_HeavyChain1
gagguccagcucgucgaguccggcggcgaccucguccagcccggccgcucccuccgccucuccugcgucgccuccggcuucaccuucgacgacuacgccaugcacuggguccgccaggcccccggcaagggccucgagugggucuccggcgucuccugguccggcuccaccgucggcuacgccgacuccgucaagggccgcuucaccgucucccgcgacaacgcccagaagucccucuaccuccagaugaacucccuccgcgccgaggacaccgcccucuacuacugcgucaaggacgccuacaaguucaacuacuacuacuacggccucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16106 - RNA, 642 nt, Artificial Sequence
  derived and/or modified sequence opt2 from Suptavumab_LightChain1
gagaucgucaugacccagucccccgccacccucuccgucucccccggcgagcgcgccacccucuccugccgcgccucccagaccauccucuccaaccucgccugguaccuccagaagcccggccaggccccccgccuccucaucuacggcgccuccacccgcgccaccggccuccccgcccgcuucuccggcuccggcuccggcaccgaguucacccucaccaucuccucccuccaguccgaggacuucgccgucuacuacugccagcaguacaacaacuggccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16107 - RNA, 1344 nt, Artificial Sequence
  derived and/or modified sequence opt2 from Suvizumab_HeavyChain1
cagguccagcucguccaguccggcgccgaggucaagaagcccggcgccuccgucaaggucuccugcaaggccuccggcuacaccuucaccaacuccuggaucggcugguuccgccaggcccccggccagggccucgaguggaucggcgacaucuaccccggcggcggcuacaccaacuacaacgagaucuucaagggcaaggccaccaugaccgccgacaccuccaccaacaccgccuacauggagcucuccucccuccgcuccgaggacaccgccgucuacuacugcucccgcggcauccccggcuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16108 - RNA, 660 nt, Artificial Sequence
  derived and/or modified sequence opt2 from Suvizumab_LightChain1
gacauccagaugacccagcgccccgacucccucuccgccuccgucggcgaccgcgucaccauguccugcaaguccucccagucccuccucaacuccggcgaccagaagaacuaccucaccugguaccagcagaagcccggccagccccccaagcuccucaucuacugggccuccaccggcgaguccggcguccccgaccgcuucuccggcuccggcuccggcaccgacuucaccuucaccaucuccucccuccagcccgaggacaucgccaccuacuacugccagaacgacuacuccuaccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16109 - RNA, 1350 nt, Artificial Sequence
  derived and/or modified sequence opt2 from Tabalumab_HeavyChain1
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagaucaaccacuccggcuccaccaacuacaaccccucccucaagucccgcgucaccaucuccgucgacaccuccaagaaccaguucucccucaagcucuccuccgucaccgccgccgacaccgccgucuacuacugcgcccgcggcuacuacgacauccucaccggcuacuacuacuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16110 - RNA, 642 nt, Artificial Sequence
  derived and/or modified sequence opt2 from Tabalumab_LightChain1
gagaucguccucacccagucccccgccacccucucccucucccccggcgagcgcgccacccucuccugccgcgccucccaguccgucucccgcuaccucgccugguaccagcagaagcccggccaggccccccgccuccucaucuacgacgccuccaaccgcgccaccggcauccccgcccgcuucuccggcuccggcuccggcaccgacuccacccucaccaucuccucccucgagcccgaggacuucgccgucuacuacugccagcagcgcuccaacuggccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccaacacccucacccucuccaaggccgacuacgagaagcacaaggucuacgccugcgaggucacccaccagggccucuccucccccgucaccaaguccuucaaccgcggcgagugc

SEQ ID NO: 16111 - RNA, 1332 nt, Artificial Sequence
  derived and/or modified sequence opt2 from Tacatuzuab_HeavyChain1
cagguccagcuccagcaguccggcgccgaggucaagaagcccggcuccuccgucaaggucuccugcaaggccuccggcuacgccuucaccuccuacgucauccacuggguccgccaggcccccggccagggccucuacuggaucggcuacauccaccccuacaacggcggcaccaaguacaacgagaaguucaagggcaaggccaccaucaccgccgacgaguccaccaacaccgccuacgagcucuccucccuccgcuccgaggacaccgccuucuacuucugcgcccgcuccggcggcggcgaccccuucgccuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 16112 - RNA, 636 nt, Artificial Sequence
  derived and/or modified sequence opt2 from Tacatuzuab_LightChain1
gacauccagcucacccagucccccuccucccucuccgccuccgucggcgaccgcgucaccaucaccugcaaggccucccaggacaucaacaaguacaucggcugguaccagcagaagcccggcaaggcccccaagcuccuccacuacaccuccgcccuccuccccggcauccccucccgcuucuccggcuccggcuccggccgcgacuacaccuucaccaucuccucccuccagcccgaggacaucgccaccuacuacugccuccaguacgacgaccucuggaccuucggcggcggcaccaagcuccagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16113 - RNA, 678 nt, Artificial Sequence
  derived and/or modified sequence opt2 from Tadocizumab_fab_fragment_HeavyChain
cagguccagcucguccaguccggcgccgaggucaagaagcccggcuccuccgucaaggucuccugcaaggccuccggcuacgccuucaccaacuaccucaucgaguggguccgccaggcccccggccagggccucgaguggaucggcgucaucuaccccggcuccggcggcaccaacuacaacgagaaguucaagggccgcgucacccucaccgucgacgaguccaccaacaccgccuacauggagcucuccucccuccgcuccgaggacaccgccgucuacuucugcgcccgccgcgacggcaacuacggcugguucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccac

SEQ ID NO: 16114 - RNA, 582 nt, Artificial Sequence
  derived and/or modified sequence opt2 from Tadocizumab_fab_fragment_LightChain
gacauccagaugacccagacccccuccacccucuccgccuccgucggcgaccgcgucaccaucuccugccgcgccucccaggacaucaacaacuaccucaacugguaccagcagaagcccggcaaggcccccaagcuccucaucuacuacaccuccacccuccacuccggcguccccucccgcuucuccggcuccggcuccggcaccgacuacacccucaccaucuccucccuccagcccgacgacuucgccaccuacuucugccagcagggcaacacccuccccuggaccuucggccagggcaccaaggucgaggucaagcgcaccgucgccgcccccuccgucuucaucuucccccccuccgacgagcagcucaaguccggcaccgccuccgucgucugccuccucaacaacuucuacgaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16115 - RNA, 1359 nt, Artificial Sequence
  derived and/or modified sequence opt2 from Talizumab_HeavyChain1
cagguccagcucguccaguccggcgccgaggucaagaagcccggcgccuccgucaaggucuccugcaaggccuccggcuacaccuucuccauguacuggcucgaguggguccgccaggcccccggccacggccucgagugggucggcgagaucucccccggcaccuucaccaccaacuacaacgagaaguucaaggcccgcgccaccuucaccgccgacaccuccaccaacaccgccuacauggagcucuccucccuccgcuccgaggacaccgccgucuacuacugcgcccgcuucucccacuucuccggcuccaacuacgacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16116 - RNA, 642 nt, Artificial Sequence
  derived and/or modified sequence opt2 from Talizumab_LightChain1
gacauccuccucacccagucccccggcacccucucccucucccccggcgagcgcgccacccucuccugccgcgccucccaguccaucggcaccaacauccacugguaccagcagaagcccggccaggccccccgccuccucaucaaguacgccuccgaguccaucuccggcauccccucccgcuucuccggcuccggcuccggcaccgacuucacccucaccaucucccgccucgagcccgaggacuucgccauguacuacugccagcaguccgacuccuggcccaccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16117 - RNA, 1368 nt, Artificial Sequence
  derived and/or modified sequence opt2 from Tamtuvetmab_HeavyChain1
gaggucaagcuccucgaguccggcggcggccucguccagcccggcggcuccaugcgccucuccugcgccggcuccggcuucaccuucaccgacuucuacaugaacuggauccgccagcccgccggcaaggcccccgaguggcucggcuucauccgcgacaaggccaagggcuacaccaccgaguacaaccccuccgucaagggccgcuucaccaucucccgcgacaacacccagaacaugcucuaccuccagaugaacacccuccgcgccgaggacaccgccaccuacuacugcgcccgcgagggccacaccgccgcccccuucgacuacuggggccagggcacccucgucaccgucuccuccgccuccaccaccgcccccuccgucuucccccucgcccccuccugcggcuccaccuccggcuccaccgucgcccucgccugccucgucuccggcuacuuccccgagcccgucaccgucuccuggaacuccggcucccucaccuccggcguccacaccuuccccuccguccuccaguccuccggccucuacucccucuccuccauggucaccguccccuccucccgcuggcccuccgagaccuucaccugcaacgucgcccaccccgccuccaagaccaaggucgacaagcccguccccaagcgcgagaacggccgcgucccccgcccccccgacugccccaagugccccgcccccgagaugcucggcggccccuccgucuucaucuucccccccaagcccaaggacacccuccucaucgcccgcacccccgaggucaccugcgucgucgucgaccucgaccccgaggaccccgagguccagaucuccugguucgucgacggcaagcagaugcagaccgccaagacccagccccgcgaggagcaguucaacggcaccuaccgcgucgucuccguccuccccaucggccaccaggacuggcucaagggcaagcaguucaccugcaaggucaacaacaaggcccuccccucccccaucgagcgcaccaucuccaaggcccgcggccaggcccaccagcccuccgucuacguccucccccccucccgcgaggagcucuccaagaacaccgucucccucaccugccucaucaaggacuucuucccccccgacaucgacgucgaguggcaguccaacggccagcaggagcccgaguccaaguaccgcaccacccccccccagcucgacgaggacggcuccuacuuccucuacuccaagcucuccgucgacaagucccgcuggcagcgcggcgacaccuucaucugcgccgucaugcacgaggcccuccacaaccacuacacccagaagucccucucccacucccccggcaag

SEQ ID NO: 16118 - RNA, 639 nt, Artificial Sequence
  derived and/or modified sequence opt2 from Tamtuvetmab_LightChain1
gacaucaagaugacccagucccccuccuuccucuccgccuccgucggcgaccgcgucacccucaacugcaaggccucccagaacaucgacaaguaccucaacugguaccagcagaagcucggcgagucccccaagcuccucaucuacaacaccaacaaccuccagaccggcauccccucccgcuucuccggcuccggcuccggcaccgacuucacccucaccaucuccucccuccagcccgaggacgucgccaccuacuucugccuccagcacaucucccgcccccgcaccuucggcggcggcacccaccucaccguccucggccagcccaaggccucccccuccgucacccucuucccccccuccuccgaggagcucggcgccaacaaggccacccucgucugccucaucuccgacuucuaccccuccggcgucaccgucgccuggaaggccgacggcucccccaucacccagggcgucgagaccaccaagcccuccaagcaguccaacaacaaguacgccgccuccuccuaccucucccucacccccgacaaguggaagucccacuccuccuucuccugccucgucacccacgagggcuccaccgucgagaagaaggucgcccccgccgagugcucc

SEQ ID NO: 16119 - RNA, 360 nt, Artificial Sequence
  derived and/or modified sequence opt2 from Tanezumab_HeavyChain
cagguccagcuccaggaguccggccccggccucgucaagcccuccgagacccucucccucaccugcaccgucuccggcuucucccucaucggcuacgaccucaacuggauccgccagccccccggcaagggccucgaguggaucggcaucaucuggggcgacggcaccaccgacuacaacuccgccgucaagucccgcgucaccaucuccaaggacaccuccaagaaccaguucucccucaagcucuccuccgucaccgccgccgacaccgccgucuacuacugcgcccgcggcggcuacugguacgccaccuccuacuacuucgacuacuggggccagggcacccucgucaccgucucc

SEQ ID NO: 16120 - RNA, 327 nt, Artificial Sequence
  derived and/or modified sequence opt2 from Tanezumab_LightChain
gacauccagaugacccagucccccuccucccucuccgccuccgucggcgaccgcgucaccaucaccugccgcgccucccaguccaucuccaacaaccucaacugguaccagcagaagcccggcaaggcccccaagcuccucaucuacuacaccucccgcuuccacuccggcguccccucccgcuucuccggcuccggcuccggcaccgacuucaccuucaccaucuccucccuccagcccgaggacaucgccaccuacuacugccagcaggagcacacccuccccuacaccuucggccagggcaccaagcucgagaucaagcgcacc

SEQ ID NO: 16121 - RNA, 1323 nt, Artificial Sequence
  derived and/or modified sequence opt2 from Tarextumab_HeavyChain1
gagguccagcucgucgaguccggcggcggccucguccagcccggcggcucccuccgccucuccugcgccgccuccggcuucaccuucuccuccuccggcauguccuggguccgccaggcccccggcaagggccucgagugggucuccgucaucgccuccuccggcuccaacaccuacuacgccgacuccgucaagggccgcuucaccaucucccgcgacaacuccaagaacacccucuaccuccagaugaacucccuccgcgccgaggacaccgccgucuacuacugcgcccgcuccaucuucuacaccaccuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16122 - RNA, 645 nt, Artificial Sequence
  derived and/or modified sequence opt2 from Tarextumab_LightChain1
gacaucguccucacccagucccccgccacccucucccucucccccggcgagcgcgccacccucuccugccgcgccucccaguccguccgcuccaacuaccucgccugguaccagcagaagcccggccaggccccccgccuccucaucuacggcgccuccucccgcgccaccggcguccccgcccgcuucuccggcuccggcuccggcaccgacuucacccucaccaucuccucccucgagcccgaggacuucgccgucuacuacugccagcaguacuccaacuuccccaucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16123 - RNA, 363 nt, Artificial Sequence
  derived and/or modified sequence opt2 from Tefibazumab_HeavyChain1
cagguccagcucaaggaguccggccccggccucgucaagcccucccagacccucuccaucaccugcaccaucuccggcuucucccucucccgcuacuccguccacuggguccgccagccccccggcaagggccucgaguggcucggcaugaucuggggcggcggcaacaccgacuacaacuccgcccucaagucccgccucuccaucuccaaggacaacuccaagaaccaggucuuccucaagaugaacucccucaccgccgccgacaccgccgucuacuacugcgcccgcaagggcgaguucuacuacggcuacgacggcuucgucuacuggggccagggcacccucgucaccgucuccucc

SEQ ID NO: 16124 - RNA, 336 nt, Artificial Sequence
  derived and/or modified sequence opt2 from Tefibazumab_LightChain1
gacaucgucaugacccagucccccgacucccucgccgucucccucggcgagcgcgucaccaugaacugcaaguccucccaguccguccucuacuccuccaaccagaagaacuaccucgccugguaccagcagaagcccggccagucccccaagcuccucaucuacugggccuccacccgcgaguccggcguccccgaccgcuucuccggcuccggcuccggcaccgacuucacccucaccaucuccuccguccaggccgaggaccucgccgucuacuacugccaccaguaccucuccuccuacaccuucggcggcggcaccaagcucgagaucaag

SEQ ID NO: 16125 - RNA, 1368 nt, Artificial Sequence
  derived and/or modified sequence opt2 from Tenatumomab_HeavyChain1
gagauccagcuccagcaguccggccccgagcucgucaagcccggcgccuccgucaaggucuccugcaaggccuccggcuacgccuucaccuccuacaacauguacugggucaagcagucccacggcaagucccucgaguggaucggcuacaucgaccccuacaacggcgucaccuccuacaaccagaaguucaagggcaaggccacccucaccgucgacaaguccuccuccaccgccuacaugcaccucaacucccucaccuccgaggacuccgccgucuacuacugcgcccgcggcggcggcuccaucuacuacgccauggacuacuggggccagggcaccuccgucaccgucuccuccgccaagaccaccccccccuccgucuacccccucgcccccggcugcggcgacaccaccggcuccuccgucacccucggcugccucgucaagggcuacuuccccgaguccgucaccgucaccuggaacuccggcucccucuccuccuccguccacaccuuccccgcccuccuccaguccggccucuacaccauguccuccuccgucaccguccccuccuccaccuggcccucccagaccgucaccugcuccgucgcccaccccgccuccuccaccaccgucgacaagaagcucgagcccuccggccccaucuccaccaucaaccccugcccccccugcaaggagugccacaagugccccgcccccaaccucgagggcggccccuccgucuucaucuucccccccaacaucaaggacguccucaugaucucccucacccccaaggucaccugcgucgucgucgacgucuccgaggacgaccccgacguccagaucuccugguucgucaacaacgucgagguccacaccgcccagacccagacccaccgcgaggacuacaacuccaccauccgcgucgucuccacccuccccauccagcaccaggacuggauguccggcaaggaguucaagugcaaggucaacaacaaggaccuccccucccccaucgagcgcaccaucuccaagaucaagggccucguccgcgccccccaggucuacauccuccccccccccgccgagcagcucucccgcaaggacgucucccucaccugccucgucgucggcuucaaccccggcgacaucuccgucgaguggaccuccaacggccacaccgaggagaacuacaaggacaccgcccccguccucgacuccgacggcuccuacuucaucuacuccaagcucaacaugaagaccuccaagugggagaagaccgacuccuucuccugcaacguccgccacgagggccucaagaacuacuaccucaagaagaccaucucccgcucccccggcaag

SEQ ID NO: 16126 - RNA, 657 nt, Artificial Sequence
  derived and/or modified sequence opt2 from Tenatumomab_LightChain1
gacaucgucaugacccaggccgcccccuccguccccgucacccccggcgaguccgucuccaucuccugccgcuccuccaagucccuccuccacuccaacggcaacaccuaccucuacugguuccuccagcgccccggccaguccccccagcuccucaucuaccgcauguccaaccucgccuccggcguccccgaccgcuucuccggcuccggcuccggcaccgccuucacccuccgcaucucccgcgucgaggccgaggacgucggcgucuacuacugcaugcagcaccucgaguacccccucaccuucggcgccggcaccaagcucgagcucaagcgcgccgacgccgcccccaccgucuccaucuucccccccuccuccgagcagcucaccuccggcggcgccuccgucgucugcuuccucaacaacuucuaccccaaggacaucaacgucaaguggaagaucgacggcuccgagcgccagaacggcguccucaacuccuggaccgaccaggacuccaaggacuccaccuacuccauguccuccacccucacccucaccaaggacgaguacgagcgccacaacuccuacaccugcgaggccacccacaagaccuccaccucccccaucgucaaguccuucaaccgcaacgagugc

SEQ ID NO: 16127 - RNA, 1356 nt, Artificial Sequence
  derived and/or modified sequence opt2 from Teneliximab_HeavyChain1
cagauccagcucguccaguccggccccgagcucaagaagcccggcgagaccguccgcaucuccugcaaggccuccggcuacgccuucaccaccaccggcaugcaguggguccaggagaugcccggcaagggccucaaguggaucggcuggaucaacacccacuccggcguccccaaguacgucgaggacuucaagggccgcuucgccuucucccucgagaccuccgccaacaccgccuaccuccagaucuccaaccucaagaacgaggacaccgccaccuacuucugcguccgcuccggcaacggcaacuacgaccucgccuacuucgccuacuggggccagggcacccucgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16128 - RNA, 642 nt, Artificial Sequence
  derived and/or modified sequence opt2 from Teneliximab_LightChain1
gacaucguccucacccagucccccgccacccucuccgucacccccggcgaccgcgucucccucuccugccgcgccucccaguccaucuccgacuaccuccacugguaccagcagaagucccacgaguccccccgccuccucaucaaguacgccucccacuccaucuccggcauccccucccgcuucuccggcuccggcuccggcuccgacuucacccucuccaucaacuccgucgagcccgaggacgucggcaucuacuacugccagcacggccacuccuuccccuggaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16129 - RNA, 1347 nt, Artificial Sequence
  derived and/or modified sequence opt2 from Teplizumab_HeavyChain1
cagguccagcucguccaguccggcggcggcgucguccagcccggccgcucccuccgccucuccugcaaggccuccggcuacaccuucacccgcuacaccaugcacuggguccgccaggcccccggcaagggccucgaguggaucggcuacaucaaccccucccgcggcuacaccaacuacaaccagaaggucaaggaccgcuucaccaucucccgcgacaacuccaagaacaccgccuuccuccagauggacucccuccgccccgaggacaccggcgucuacuucugcgcccgcuacuacgacgaccacuacugccucgacuacuggggccagggcacccccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16130 - RNA, 639 nt, Artificial Sequence
  derived and/or modified sequence opt2 from Teplizumab_LightChain1
gacauccagaugacccagucccccuccucccucuccgccuccgucggcgaccgcgucaccaucaccugcuccgccuccuccuccgucuccuacaugaacugguaccagcagacccccggcaaggcccccaagcgcuggaucuacgacaccuccaagcucgccuccggcguccccucccgcuucuccggcuccggcuccggcaccgacuacaccuucaccaucuccucccuccagcccgaggacaucgccaccuacuacugccagcagugguccuccaaccccuucaccuucggccagggcaccaagcuccagaucacccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16131 - RNA, 1344 nt, Artificial Sequence
  derived and/or modified sequence opt2 from Teprotumumab_HeavyChain1
caggucgagcucgucgaguccggcggcggcgucguccagcccggccgcucccagcgccucuccugcgccgccuccggcuucaccuucuccuccuacggcaugcacuggguccgccaggcccccggcaagggccucgagugggucgccaucaucugguucgacggcuccuccaccuacuacgccgacuccguccgcggccgcuucaccaucucccgcgacaacuccaagaacacccucuaccuccagaugaacucccuccgcgccgaggacaccgccgucuacuucugcgcccgcgagcucggccgccgcuacuucgaccucuggggccgcggcacccucgucuccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16132 - RNA, 645 nt, Artificial Sequence
  derived and/or modified sequence opt2 from Teprotumumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaagcgcgccaccggcauccccgcccgcuucuccggcuccggcuccggcaccgacuucacccucaccaucuccucccucgagcccgaggacuucgccgucuacuacugccagcagcgcuccaaguggccccccuggaccuucggccagggcaccaaggucgaguccaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16133 - RNA, 1338 nt, Artificial Sequence
  derived and/or modified sequence opt2 from Tesidolumab_HeavyChain1
gagguccagcucguccaguccggcgccgaggucaagaagcccggcuccuccgucaaggucuccugcaaggccuccggcggcaccuucuccuccuacgccaucuccuggguccgccaggcccccggccagggccucgaguggaugggcggcaucggccccuucuucggcaccgccaacuacgcccagaaguuccagggccgcgucaccaucaccgccgacgaguccaccuccaccgccuacauggagcucuccucccuccgcuccgaggacaccgccgucuacuacugcgcccgcgacacccccuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16134 - RNA, 642 nt, Artificial Sequence
  derived and/or modified sequence opt2 from Tesidolumab_LightChain1
uccuacgagcucacccagccccucuccgucuccgucgcccucggccagaccgcccgcaucaccugcuccggcgacuccauccccaacuacuacgucuacugguaccagcagaagcccggccaggcccccguccucgucaucuacgacgacuccaaccgccccuccggcauccccgagcgcuucuccggcuccaacuccggcaacaccgccacccucaccaucucccgcgcccaggccggcgacgaggccgacuacuacugccaguccuucgacuccucccucaacgccgaggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16135 - RNA, 1344 nt, Artificial Sequence
  derived and/or modified sequence opt2 from Tezepelumab_HeavyChain1
cagaugcagcucgucgaguccggcggcggcgucguccagcccggccgcucccuccgccucuccugcgccgccuccggcuucaccuuccgcaccuacggcaugcacuggguccgccaggcccccggcaagggccucgagugggucgccgucaucugguacgacggcuccaacaagcacuacgccgacuccgucaagggccgcuucaccaucacccgcgacaacuccaagaacacccucaaccuccagaugaacucccuccgcgccgaggacaccgccgucuacuacugcgcccgcgccccccagugggagcucguccacgaggccuucgacaucuggggccagggcaccauggucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16136 - RNA, 642 nt, Artificial Sequence
  derived and/or modified sequence opt2 from Tezepelumab_LightChain1
uccuacguccucacccagccccccuccgucuccgucgcccccggccagaccgcccgcaucaccugcggcggcaacaaccucggcuccaaguccguccacugguaccagcagaagcccggccaggcccccguccucgucgucuacgacgacuccgaccgccccuccuggauccccgagcgcuucuccggcuccaacuccggcaacaccgccacccucaccaucucccgcggcgaggccggcgacgaggccgacuacuacugccaggucugggacuccuccuccgaccacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16137 - RNA, 1338 nt, Artificial Sequence
  derived and/or modified sequence opt2 from ThioMAb-chMA79b-HC(A118C)_HeavyChain
gagguccagcuccagcaguccggcgccgagcucaugaagcccggcgccuccgucaagaucuccugcaaggccaccggcuacaccuucuccuccuacuggaucgagugggucaagcagcgccccggccacggccucgaguggaucggcgagauccuccccggcggcggcgacaccaacuacaacgagaucuucaagggcaaggccaccuucaccgccgacaccuccuccaacaccgccuacaugcagcucuccucccucaccuccgaggacuccgccgucuacuacugcacccgccgcguccccgucuacuucgacuacuggggccagggcaccuccgucaccgucuccuccugcuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16138 - RNA, 1347 nt, Artificial Sequence
  derived and/or modified sequence opt2 from ThioMab-hu10A8.v1-HC(A118C)_HeavyChain
gagguccagcucgucgaguccggcggcggccucguccagcccggcggcucccuccgccucuccugcgccgccuccggcuucaccuucuccuccuacgccgucuccuggguccgccaggcccccggcaagggccucgagugggucgccaccaucuccuccggcggcucccucaccuucuaccucgacuccguccgcggccgcuucaccaucucccgcgacaacuccaagaacacccucuaccuccagaugaacucccuccgcgccgaggacaccgccgucuacuacugcgcccgccccauccccgacuacuacgcccucgacuacuggggccagggcacccucgucaccgucuccuccugcuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16139 - RNA, 1347 nt, Artificial Sequence
  derived and/or modified sequence opt2 from ThioMab-hu10A8.v1-HC(V205C)_HeavyChain
gagguccagcucgucgaguccggcggcggccucguccagcccggcggcucccuccgccucuccugcgccgccuccggcuucaccuucuccuccuacgccgucuccuggguccgccaggcccccggcaagggccucgagugggucgccaccaucuccuccggcggcucccucaccuucuaccucgacuccguccgcggccgcuucaccaucucccgcgacaacuccaagaacacccucuaccuccagaugaacucccuccgcgccgaggacaccgccgucuacuacugcgcccgccccauccccgacuacuacgcccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16140 - RNA, 642 nt, Artificial Sequence
  derived and/or modified sequence opt2 from ThioMab-hu10A8.v1-LC(A118C)_LightChain
gacauccagaugacccagucccccuccucccucuccgccuccgucggcgaccgcgucaccaucaccugcaaggccucccaggacgucuccaccgccgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcagcacuucuccuccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16141 - RNA, 642 nt, Artificial Sequence
  derived and/or modified sequence opt2 from ThioMab-hu10A8.v1-LC(V205C)_LightChain
gacauccagaugacccagucccccuccucccucuccgccuccgucggcgaccgcgucaccaucaccugcaaggccucccaggacgucuccaccgccgucgccugguaccagcagaagcccggcaaggcccccaagcuccucaucuacuccgccuccuaccgcuacaccggcguccccucccgcuucuccggcuccggcuccggcaccgacuucacccucaccaucuccucccuccagcccgaggacuucgccaccuacuacugccagcagcacuucuccuccccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccugcaccaaguccuucaaccgcggcgagugc

SEQ ID NO: 16142 - RNA, 1338 nt, Artificial Sequence
  derived and/or modified sequence opt2 from ThioMAb-huMA79b.v17-HC(A118C)_HeavyChain
gagguccagcucgucgaguccggcggcggccucguccagcccggcggcucccuccgccucuccugcgccgccuccggcuacaccuucuccuccuacuggaucgaguggguccgccaggcccccggcaagggccucgaguggaucggcgagauccuccccggcggcggcgacaccaacuacaacgagaucuucaagggccgcgccaccuucuccgccgacaccuccaagaacaccgccuaccuccagaugaacucccuccgcgccgaggacaccgccgucuacuacugcacccgccgcguccccgucuacuucgacuacuggggccagggcacccucgucaccgucuccuccugcuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16143 - RNA, 654 nt, Artificial Sequence
  derived and/or modified sequence opt2 from ThioMAb-huMA79b.v17-HC(A118C)_LightChain
gacauccagcucacccagucccccuccucccucuccgccuccgucggcgaccgcgucaccaucaccugcaaggccucccaguccgucgacuacgacggcgacuccuuccucaacugguaccagcagaagcccggcaaggcccccaagcuccucaucuacgccgccuccaaccucgaguccggcguccccucccgcuucuccggcuccggcuccggcaccgacuucacccucaccaucuccucccuccagcccgaggacuucgccaccuacuacugccagcaguccaacgaggacccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16144 - RNA, 1338 nt, Artificial Sequence
  derived and/or modified sequence opt2 from ThioMAb-huMA79b.v18-HC(A118C)_HeavyChain
gagguccagcucgucgaguccggcggcggccucguccagcccggcggcucccuccgccucuccugcgccgccuccggcuacaccuucuccuccuacuggaucgaguggguccgccaggcccccggcaagggccucgaguggaucggcgagauccuccccggcggcggcgacaccaacuacaacgagaucuucaagggccgcgccaccuucuccgccgacaccuccaagaacaccgccuaccuccagaugaacucccuccgcgccgaggacaccgccgucuacuacugcacccgccgcguccccauccgccucgacuacuggggccagggcacccucgucaccgucuccuccugcuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16145 - RNA, 654 nt, Artificial Sequence; identical to SEQ ID NO: 15989
  derived and/or modified sequence opt2 from ThioMAb-huMA79b.v28-HC(A118C)_LightChain

SEQ ID NO: 16146 - RNA, 654 nt, Artificial Sequence
  derived and/or modified sequence opt2 from ThioMAb-huMA79b.v28-LC(V205C)_LightChain
gacaucguccucacccagucccccgccucccucgccgucucccucggccagcgcgccaccaucuccugcaaggccucccaguccgucgacuacgacggcgacuccuuccucaacugguaccagcagaagcccggccagccccccaagcucuucaucuacgccgccuccaaccucgaguccggcauccccgcccgcuucuccggcuccggcuccggcaccgacuucacccucaacauccaccccgucgaggaggaggacgccgccaccuacuacugccagcaguccaacgaggacccccucaccuucggcgccggcaccgagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccugcaccaaguccuucaaccgcggcgagugc

SEQ ID NO: 16147 - RNA, 1332 nt, Artificial Sequence
  derived and/or modified sequence opt2 from Ticiliuab_HeavyChain1
cagguccagcucgucgaguccggcggcggcgucguccagcccggccgcucccuccgccucuccugcgccgccuccggcuucaccuucuccuccuacggccacuggguccgccaggcccccggcaagggccucgagugggucgccgucaucugguacgacggcuccaacaaguacuacgccgacuccgucaagggccgcuucaccaucucccgcgacaacuccaagaacacccucuaccuccagaacucccuccgcgccgaggacaccgccgucuacuacugcgcccgcgacccccgcggcgccacccucuacuacuacuacuacggcgacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccacccccccccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 16148 - RNA, 639 nt, Artificial Sequence
  derived and/or modified sequence opt2 from Ticiliuab_LightChain1
gacauccagacccagucccccuccucccucuccgccuccgucggcgaccgcgucaccaucaccugccgcgccucccaguccaucaacuccuaccucgacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaguacuacuccacccccuucaccuucggccccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16149 - RNA, 1347 nt, Artificial Sequence
  derived and/or modified sequence opt2 from Tigatuzumab_HeavyChain1
gagguccagcucgucgaguccggcggcggccucguccagcccggcggcucccuccgccucuccugcgccgccuccggcuucaccuucuccuccuacgucauguccuggguccgccaggcccccggcaagggccucgagugggucgccaccaucuccuccggcggcuccuacaccuacuaccccgacuccgucaagggccgcuucaccaucucccgcgacaacgccaagaacacccucuaccuccagaugaacucccuccgcgccgaggacaccgccgucuacuacugcgcccgccgcggcgacuccaugaucaccaccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16150 - RNA, 1347 nt, Artificial Sequence; identical to SEQ ID NO: 16149
  derived and/or modified sequence opt2 from Tigatuzumab_HeavyChain

SEQ ID NO: 16151 - RNA, 639 nt, Artificial Sequence
  derived and/or modified sequence opt2 from Tigatuzumab_LightChain1
gacauccagaugacccagucccccuccucccucuccgccuccgucggcgaccgcgucaccaucaccugcaaggccucccaggacgucggcaccgccgucgccugguaccagcagaagcccggcaaggcccccaagcuccucaucuacugggccuccacccgccacaccggcguccccucccgcuucuccggcuccggcuccggcaccgacuucacccucaccaucuccucccuccagcccgaggacuucgccaccuacuacugccagcaguacuccuccuaccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16152 - RNA, 639 nt, Artificial Sequence; identical to SEQ ID NO: 16151
  derived and/or modified sequence opt2 from Tigatuzumab_LightChain

SEQ ID NO: 16153 - RNA, 1338 nt, Artificial Sequence
  derived and/or modified sequence opt2 from Tildrakizumab_HeavyChain1
cagguccagcucguccaguccggcgccgaggucaagaagcccggcgccuccgucaaggucuccugcaaggccuccggcuacaucuucaucaccuacuggaugaccuggguccgccaggcccccggccagggccucgaguggaugggccagaucuuccccgccuccggcuccgccgacuacaacgagaaguucgagggccgcgucaccaugaccaccgacaccuccaccuccaccgccuacauggagcuccgcucccuccgcuccgacgacaccgccgucuacuacugcgcccgcggcggcggcggcuucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16154 - RNA, 642 nt, Artificial Sequence
  derived and/or modified sequence opt2 from Tildrakizumab_LightChain1
gacauccagaugacccagucccccuccucccucuccgccuccgucggcgaccgcgucaccaucaccugccgcaccuccgagaacaucuacuccuaccucgccugguaccagcagaagcccggcaaggcccccaagcuccucaucuacaacgccaagacccucgccgagggcguccccucccgcuucuccggcuccggcuccggcaccgacuucacccucaccaucuccucccuccagcccgaggacuucgccaccuacuacugccagcaccacuacggcauccccuucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16155 - RNA, 1344 nt, Artificial Sequence
  derived and/or modified sequence opt2 from Tisotumab_vedotin_HeavyChain1
gagguccagcuccucgaguccggcggcggccucguccagcccggcggcucccuccgccucuccugcgccgccuccggcuucaccuucuccaacuacgccauguccuggguccgccaggcccccggcaagggccucgagugggucuccuccaucuccggcuccggcgacuacaccuacuacaccgacuccgucaagggccgcuucaccaucucccgcgacaacuccaagaacacccucuaccuccagaugaacucccuccgcgccgaggacaccgccgucuacuacugcgcccgcucccccuggggcuacuaccucgacuccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16156 - RNA, 642 nt, Artificial Sequence
  derived and/or modified sequence opt2 from Tisotumab_vedotin_LightChain1
gacauccagaugacccaguccccccccucccucuccgccuccgccggcgaccgcgucaccaucaccugccgcgccucccagggcaucuccucccgccucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacuccuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16157 - RNA, 1341 nt, Artificial Sequence
  derived and/or modified sequence opt2 from Tocilizumab_HeavyChain1
guccagcuccaggaguccggccccggccucguccgccccucccagacccucucccucaccugcaccgucuccggcuacuccaucaccuccgaccacgccugguccuggguccgccagccccccggccgcggccucgaguggaucggcuacaucuccuacuccggcaucaccaccuacaaccccucccucaagucccgcgucaccaugcuccgcgacaccuccaagaaccaguucucccuccgccucuccuccgucaccgccgccgacaccgccgucuacuacugcgcccgcucccucgcccgcaccaccgccauggacuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16158 - RNA, 642 nt, Artificial Sequence
  derived and/or modified sequence opt2 from Tocilizumab_LightChain1
gacauccagaugacccagucccccuccucccucuccgccuccgucggcgaccgcgucaccaucaccugccgcgccucccaggacaucuccuccuaccucaacugguaccagcagaagcccggcaaggcccccaagcuccucaucuacuacaccucccgccuccacuccggcguccccucccgcuucuccggcuccggcuccggcaccgacuucaccuucaccaucuccucccuccagcccgaggacaucgccaccuacuacugccagcagggcaacacccuccccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16159 - RNA, 1353 nt, Artificial Sequence
  derived and/or modified sequence opt2 from Tosatoxumab_HeavyChain1
gagguccagaugguccaguccggcgccgaggucaagaagcccggcgagccccucaagaucuccugcaagggcuccggcuacaaguucggcacccacuggaucggcuggguccgccagcgccccggcaagggccucgaguggaugggcaucauccaccccgccgacuccgagaccaaguacucccccuccuuccagggccaggucuccuucuccgccgacaaguccuccaacaccgccuaccuccacugguccacccuccgcgccuccgacaccgccauguacuacugcgcccgccgcuccggcuccuccuccugguacgcccucgacuucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16160 - RNA, 651 nt, Artificial Sequence
  derived and/or modified sequence opt2 from Tosatoxumab_LightChain1
caguccguccucacccagucccccuccgccuccggcacccccggccagcgcgucaccaucuccugcuccggcggcuccuccaacaucggcuccaacaccgucaacugguaccagcaguuccccggcgccgcccccaagcuccucaucuacaccaacaaccagcgccccuccggcguccccgaccgcuucuccggcuccaaguccggcaccuccgccucccucgccaucuccggccuccaguccgaggacgaggccgacuacuacugcgccaccugggacgacucccucaacggccucuacgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16161 - RNA, 1341 nt, Artificial Sequence
  derived and/or modified sequence opt2 from Tositumomab_HeavyChain
caggccuaccuccagcaguccggcgccgagcucguccgccccggcgccuccgucaagauguccugcaaggccuccggcuacaccuucaccuccuacaacaugcacugggucaagcagaccccccgccagggccucgaguggaucggcgccaucuaccccggcaacggcgacaccuccuacaaccagaaguucaagggcaaggccacccucaccgucgacaaguccuccuccaccgccuacaugcagcucuccucccucaccuccgaggacuccgccgucuacuucugcgcccgcgucgucuacuacuccaacuccuacugguacuucgacgucuggggcaccggcaccaccgucaccgucuccggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16162 - RNA, 630 nt, Artificial Sequence
  derived and/or modified sequence opt2 from Tositumomab_LightChain
cagaucguccucucccagucccccgccauccucuccgccucccccggcgagaaggucaccaugaccugccgcgccuccuccuccgucuccuacaugcacugguaccagcagaagcccggcuccucccccaagcccuggaucuacgcccccuccaaccucgccuccggcguccccgcccgcuucuccggcuccggcuccggcaccuccuacucccucaccaucucccgcgucgaggccgaggacgccgccaccuacuacugccagcagugguccuucaacccccccaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 16163 - RNA, 1338 nt, Artificial Sequence
  derived and/or modified sequence opt2 from Tovetumab_HeavyChain1
cagguccagcucgucgaguccggcggcggccucgucaagcccggcggcucccuccgccucuccugcgccgccuccggcuucaccuucuccgacuacuacaugaacuggauccgccaggcccccggcaagggccucgagugggucuccuacaucuccuccuccggcuccaucaucuacuacgccgacuccgucaagggccgcuucaccaucucccgcgacaacgccaagaacucccucuaccuccagaugaacucccuccgcgccgaggacaccgccgucuacuacugcgcccgcgagggccgcaucgccgcccgcggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16164 - RNA, 645 nt, Artificial Sequence
  derived and/or modified sequence opt2 from Tovetumab_LightChain1
gacauccagaugacccagucccccuccucccucuccgccuccgucggcgaccgcgucuccaucaccugccgccccucccaguccuucucccgcuacaucaacugguaccagcagaagcccggcaaggcccccaagcuccucauccacgccgccuccucccucgucggcggcguccccucccgcuucuccggcuccggcuccggcaccgacuucacccucaccaucuccucccuccagcccgaggacuucgccaccuacuacugccagcagaccuacuccaacccccccaucaccuucggccagggcacccgccucgagaugaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16165 - RNA, 1347 nt, Artificial Sequence
  derived and/or modified sequence opt2 from Tralokinumab_HeavyChain1
cagguccagcucguccaguccggcgccgaggucaagaagcccggcgccuccgucaaggucuccugcaaggccuccggcuacaccuucaccaacuacggccucuccuggguccgccaggcccccggccagggccucgaguggaugggcuggaucuccgccaacaacggcgacaccaacuacggccaggaguuccagggccgcgucaccaugaccaccgacaccuccaccuccaccgccuacauggagcuccgcucccuccgcuccgacgacaccgccgucuacuacugcgcccgcgacuccuccuccuccugggcccgcugguucuucgaccucuggggccgcggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16166 - RNA, 642 nt, Artificial Sequence
  derived and/or modified sequence opt2 from Tralokinumab_LightChain1
uccuacguccucacccagccccccuccgucuccgucgcccccggcaagaccgcccgcaucaccugcggcggcaacaucaucggcuccaagcucguccacugguaccagcagaagcccggccaggcccccguccucgucaucuacgacgacggcgaccgccccuccggcauccccgagcgcuucuccggcuccaacuccggcaacaccgccacccucaccaucucccgcgucgaggccggcgacgaggccgacuacuacugccaggucugggacaccggcuccgaccccgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16167 - RNA, 1332 nt, Artificial Sequence
  derived and/or modified sequence opt2 from Trastuzuab_HeavyChain1
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaacucccuccgcgccgaggacaccgccgucuacuacugcucccgcuggggcggcgacggcuucuacgccgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggc

SEQ ID NO: 16168 - RNA, 639 nt, Artificial Sequence
  derived and/or modified sequence opt2 from Trastuzuab_LightChain1
gacauccagacccagucccccuccucccucuccgccuccgucggcgaccgcgucaccaucaccugccgcgccucccaggacgucaacaccgccgucgccugguaccagcagaagcccggcaaggcccccaagcuccucaucuacuccgccuccuuccucuacuccggcguccccucccgcuucuccggcucccgcuccggcaccgacuucacccucaccaucuccucccuccagcccgaggacuucgccaccuacuacugccagcagcacuacaccaccccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16169 - RNA, 1347 nt, Artificial Sequence
  derived and/or modified sequence opt2 from Trastuzumab_emtansine_HeavyChain1
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16170 - RNA, 642 nt, Artificial Sequence; identical to SEQ ID NO: 16026
  derived and/or modified sequence opt2 from Trastuzumab_emtansine_LightChain1

SEQ ID NO: 16171 - RNA, 1347 nt, Artificial Sequence; identical to SEQ ID NO: 16169
  derived and/or modified sequence opt2 from Trastuzumab_HeavyChain1

SEQ ID NO: 16172 - RNA, 1353 nt, Artificial Sequence
  derived and/or modified sequence opt2 from Trastuzumab_HeavyChain
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16173 - RNA, 660 nt, Artificial Sequence
  derived and/or modified sequence opt2 from Trastuzumab_HeavyChain_variant_1n8z_B
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccc

SEQ ID NO: 16174 - RNA, 45 nt, Artificial Sequence
  derived and/or modified sequence opt2 from Trastuzumab_HeavyChain_variant_7637_H
gagcccaaguccugcgacaagacccacaccugcccccccugcccc

SEQ ID NO: 16175 - RNA, 642 nt, Artificial Sequence; identical to SEQ ID NO: 16026
  derived and/or modified sequence opt2 from Trastuzumab_LightChain1

SEQ ID NO: 16176 - RNA, 642 nt, Artificial Sequence; identical to SEQ ID NO: 16026
  derived and/or modified sequence opt2 from Trastuzumab_LightChain_variant_1n8z_A

SEQ ID NO: 16177 - RNA, 642 nt, Artificial Sequence; identical to SEQ ID NO: 16026
  derived and/or modified sequence opt2 from Trastuzumab_LightChain_variant_7637_L

SEQ ID NO: 16178 - RNA, 1344 nt, Artificial Sequence
  derived and/or modified sequence opt2 from TRC-105_HeavyChain1
gaggucaagcucgaggaguccggcggcggccucguccagcccggcggcuccaugaagcucuccugcgccgccuccggcuucaccuucuccgacgccuggauggacuggguccgccagucccccgagaagggccucgagugggucgccgagauccgcuccaaggccuccaaccacgccaccuacuacgccgaguccgucaagggccgcuucaccaucucccgcgacgacuccaaguccuccgucuaccuccagaugaacucccuccgcgccgaggacaccggcaucuacuacugcacccgcuggcgccgcuucuucgacuccuggggccagggcaccacccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16179 - RNA, 639 nt, Artificial Sequence
  derived and/or modified sequence opt2 from TRC-105_LightChain1
cagaucguccucucccagucccccgccauccucuccgccucccccggcgagaaggucaccaugaccugccgcgccuccuccuccgucuccuacaugcacugguaccagcagaagcccggcuccucccccaagcccuggaucuacgccaccuccaaccucgccuccggcguccccguccgcuucuccggcuccggcuccggcaccuccuacucccucaccaucucccgcgucgaggccgaggacgccgccaccuacuacugccagcagugguccuccaacccccucaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16180 - RNA, 1362 nt, Artificial Sequence
  derived and/or modified sequence opt2 from Tregalizumab_HeavyChain1
gaggagcagcucgucgaguccggcggcggccucgucaagcccggcggcucccuccgccucuccugcgccgccuccggcuucuccuucuccgacugccgcauguacuggcuccgccaggcccccggcaagggccucgaguggaucggcgucaucuccgucaaguccgagaacuacggcgccaacuacgccgaguccguccgcggccgcuucaccaucucccgcgacgacuccaagaacaccgucuaccuccagaugaacucccucaagaccgaggacaccgccgucuacuacugcuccgccuccuacuaccgcuacgacgucggcgccugguucgccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16181 - RNA, 654 nt, Artificial Sequence
  derived and/or modified sequence opt2 from Tregalizumab_LightChain1
gacaucgucaugacccagucccccgacucccucgccgucucccucggcgagcgcgccaccaucaacugccgcgccuccaaguccgucuccaccuccggcuacuccuacaucuacugguaccagcagaagcccggccagccccccaagcuccucaucuaccucgccuccauccucgaguccggcguccccgaccgcuucuccggcuccggcuccggcaccgacuucacccucaccaucuccucccuccaggccgaggacgucgccgucuacuacugccagcacucccgcgagcuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16182 - RNA, 1353 nt, Artificial Sequence
  derived and/or modified sequence opt2 from Tremelimumab_HeavyChain1
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucugguacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcgacccccgcggcgccacccucuacuacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16183 - RNA, 642 nt, Artificial Sequence
  derived and/or modified sequence opt2 from Tremelimumab_LightChain1
gacauccagaugacccagucccccuccucccucuccgccuccgucggcgaccgcgucaccaucaccugccgcgccucccaguccaucaacuccuaccucgacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaguacuacuccacccccuucaccuucggccccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16184 - RNA, 1341 nt, Artificial Sequence
  derived and/or modified sequence opt2 from Trevogrumab_HeavyChain1
gagguccagguccucgaguccggcggcgaccucguccagcccggcggcucccuccgccucuccugcgccgccuccggcuucaccuucuccgccuacgccaugaccuggguccgccaggcccccggcaagggccucgagugggucuccgccaucuccggcuccggcggcuccgccuacuacgccgacuccgucaagggccgcuucaccaucucccgcgacaacuccaagaacaccgucuaccuccagaugaacucccuccgcgccgaggacaccgccgucuacuacugcgccaaggacggcgccuggaagauguccggccucgacgucuggggccagggcaccaccgucaucgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16185 - RNA, 642 nt, Artificial Sequence
  derived and/or modified sequence opt2 from Trevogrumab_LightChain1
gacauccagaugacccagucccccgccucccucuccgccuccgucggcgaccgcgucaccaucaccugccgcgccucccaggacaucuccgacuaccucgccugguaccagcagaagcccggcaagaucccccgccuccucaucuacaccaccuccacccuccaguccggcguccccucccgcuuccgcggcuccggcuccggcaccgacuucacccucaccaucuccucccuccagcccgaggacgucgccaccuacuacugccagaaguacgacuccgccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16186 - RNA, 1737 nt, Artificial Sequence
  derived and/or modified sequence opt2 from Tucotuzumab_celmoleukin_HeavyChain1
cagauccagcucguccaguccggcgccgaggucaagaagcccggcgagaccgucaagaucuccugcaaggccuccggcuacaccuucaccaacuacggcaugaacugggucaagcagacccccggcaagggccucaaguggaugggcuggaucaacaccuacaccggcgagcccaccuacgccgacgacuucaagggccgcuucgccuucucccucgagaccuccaccuccaccgccuuccuccagaucaacaaccuccgcuccgaggacaccgccaccuacuucugcguccgcuucaucuccaagggcgacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaaggcccccaccuccuccuccaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcaccuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucacc

SEQ ID NO: 16187 - RNA, 639 nt, Artificial Sequence
  derived and/or modified sequence opt2 from Tucotuzumab_celmoleukin_LightChain1
gagaucguccucacccagucccccgccacccucucccucucccccggcgagcgcgucacccucaccugcuccgccuccuccuccgucuccuacaugcucugguaccagcagaagcccggcuccucccccaagcccuggaucuucgacaccuccaaccucgccuccggcuuccccgcccgcuucuccggcuccggcuccggcaccuccuacucccucaucaucuccuccauggaggccgaggacgccgccaccuacuacugccaccagcgcuccggcuaccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16188 - RNA, 1344 nt, Artificial Sequence
  derived and/or modified sequence opt2 from Ublituximab_HeavyChain1
caggccuaccuccagcaguccggcgccgagcucguccgccccggcgccuccgucaagauguccugcaaggccuccggcuacaccuucaccuccuacaacaugcacugggucaagcagaccccccgccagggccucgaguggaucggcggcaucuaccccggcaacggcgacaccuccuacaaccagaaguucaagggcaaggccacccucaccgucggcaaguccuccuccaccgccuacaugcagcucuccucccucaccuccgaggacuccgccgucuacuucugcgcccgcuacgacuacaacuacgccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16189 - RNA, 639 nt, Artificial Sequence
  derived and/or modified sequence opt2 from Ublituximab_LightChain1
cagaucguccucucccagucccccgccauccucuccgccucccccggcgagaaggucaccaugaccugccgcgccuccuccuccgucuccuacaugcacugguaccagcagaagcccggcuccucccccaagcccuggaucuacgccaccuccaaccucgccuccggcguccccgcccgcuucuccggcuccggcuccggcaccuccuacuccuucaccaucucccgcgucgaggccgaggacgccgccaccuacuacugccagcaguggaccuucaacccccccaccuucggcggcggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16190 - RNA, 1353 nt, Artificial Sequence
  derived and/or modified sequence opt2 from Ulocuplumab_HeavyChain1
gagguccagcucgucgaguccggcggcggccucguccagcccggcggcucccuccgccucuccugcgccgccgccggcuucaccuucuccuccuacuccaugaacuggguccgccaggcccccggcaagggccucgagugggucuccuacaucuccucccgcucccgcaccaucuacuacgccgacuccgucaagggccgcuucaccaucucccgcgacaacgccaagaacucccucuaccuccagaugaacucccuccgcgacgaggacaccgccgucuacuacugcgcccgcgacuacggcggccagccccccuacuacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggc

SEQ ID NO: 16191 - RNA, 642 nt, Artificial Sequence
  derived and/or modified sequence opt2 from Ulocuplumab_LightChain1
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgucaccuacuacugccagcaguacaacuccuacccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16192 - RNA, 1344 nt, Artificial Sequence
  derived and/or modified sequence opt2 from Urelumab_HeavyChain1
cagguccagcuccagcaguggggcgccggccuccucaagcccuccgagacccucucccucaccugcgccgucuacggcggcuccuucuccggcuacuacugguccuggauccgccagucccccgagaagggccucgaguggaucggcgagaucaaccacggcggcuacgucaccuacaaccccucccucgagucccgcgucaccaucuccgucgacaccuccaagaaccaguucucccucaagcucuccuccgucaccgccgccgacaccgccgucuacuacugcgcccgcgacuacggccccggcaacuacgacugguacuucgaccucuggggccgcggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16193 - RNA, 648 nt, Artificial Sequence
  derived and/or modified sequence opt2 from Urelumab_LightChain1
gagaucguccucacccagucccccgccacccucucccucucccccggcgagcgcgccacccucuccugccgcgccucccaguccgucuccuccuaccucgccugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuccaacuggccccccgcccucaccuucugcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16194 - RNA, 1347 nt, Artificial Sequence
  derived and/or modified sequence opt2 from Urtoxazumab_HeavyChain1
gagguccagcucgucgaguccggcggcggccucguccagcccggcggcucccuccgccucuccugcgccgccuccggcuucaccuucuccuccuacggcauguccuggguccgccaggcccccggcaagggccucgagugggucgccaccaucuccaccggcggcuccuacaccuacuaccccgacuccgucaagggccgcuucaccaucucccgcgacaacgccaagaacacccucuaccuccagaugaacucccuccgcgccgaggacaccgccgucuacuacugcgcccgccgcggcgacgccuggggcaaccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16195 - RNA, 642 nt, Artificial Sequence
  derived and/or modified sequence opt2 from Urtoxazumab_LightChain1
gagaucguccucacccagucccccgccacccucuccgucucccccggcgagcgcgccacccucuccugccgcgccucccagaccaucuccaacaaccuccacugguaccagcagaagcccggccaggccccccgccuccucaucaaguccgccucccaguccaucuccggcauccccgcccgcuucuccggcuccggcuccggcaccgacuucacccucaccaucuccucccucgaguccgaggacuucgccgucuacuacugccagcaguccuacuccuggccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16196 - RNA, 1347 nt, Artificial Sequence
  derived and/or modified sequence opt2 from Ustekinumab_HeavyChain1
gagguccagcucguccaguccggcgccgaggucaagaagcccggcgagucccucaagaucuccugcaagggcuccggcuacuccuucaccaccuacuggcucggcuggguccgccagaugcccggcaagggccucgacuggaucggcaucaugucccccgucgacuccgacauccgcuacucccccuccuuccagggccaggucaccauguccgucgacaaguccaucaccaccgccuaccuccaguggaacucccucaaggccuccgacaccgccauguacuacugcgcccgccgccgccccggccagggcuacuucgacuucuggggccagggcacccucgucaccgucuccuccuccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16197 - RNA, 642 nt, Artificial Sequence
  derived and/or modified sequence opt2 from Ustekinumab_LightChain1
gacauccagaugacccagucccccuccucccucuccgccuccgucggcgaccgcgucaccaucaccugccgcgccucccagggcaucuccuccuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacaucuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16198 - RNA, 1341 nt, Artificial Sequence
  derived and/or modified sequence opt2 from Vadastuximab_talirine_HeavyChain1
cagguccagcucguccaguccggcgccgaggucaagaagcccggcgccuccgucaaggucuccugcaaggccuccggcuacaccuucaccaacuacgacaucaacuggguccgccaggcccccggccagggccucgaguggaucggcuggaucuaccccggcgacggcuccaccaaguacaacgagaaguucaaggccaaggccacccucaccgccgacaccuccaccuccaccgccuacauggagcuccgcucccuccgcuccgacgacaccgccgucuacuacugcgccuccggcuacgaggacgccauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccugcgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16199 - RNA, 642 nt, Artificial Sequence
  derived and/or modified sequence opt2 from Vadastuximab_talirine_LightChain1
gacauccagaugacccagucccccuccucccucuccgccuccgucggcgaccgcgucaccaucaacugcaaggccucccaggacaucaacuccuaccucuccugguuccagcagaagcccggcaaggcccccaagacccucaucuaccgcgccaaccgccucgucgacggcguccccucccgcuucuccggcuccggcuccggccaggacuacacccucaccaucuccucccuccagcccgaggacuucgccaccuacuacugccuccaguacgacgaguucccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16200 - RNA, 1362 nt, Artificial Sequence
  derived and/or modified sequence opt2 from Vandortuzumab_vedotin_HeavyChain1
gagguccagcucgucgaguccggcggcggccucguccagcccggcggcucccuccgccucuccugcgccgucuccggcuacuccaucaccuccgacuacgccuggaacuggguccgccaggcccccggcaagggccucgagugggucggcuacaucuccaacuccggcuccaccuccuacaaccccucccucaagucccgcuucaccaucucccgcgacaccuccaagaacacccucuaccuccagaugaacucccuccgcgccgaggacaccgccgucuacuacugcgcccgcgagcgcaacuacgacuacgacgacuacuacuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16201 - RNA, 660 nt, Artificial Sequence
  derived and/or modified sequence opt2 from Vandortuzumab_vedotin_LightChain1
gacauccagaugacccagucccccuccucccucuccgccuccgucggcgaccgcgucaccaucaccugcaaguccucccagucccuccucuaccgcuccaaccagaagaacuaccucgccugguaccagcagaagcccggcaaggcccccaagcuccucaucuacugggccuccacccgcgaguccggcguccccucccgcuucuccggcuccggcuccggcaccgacuucacccucaccaucuccucccuccagcccgaggacuucgccaccuacuacugccagcaguacuacaacuacccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16202 - RNA, 1329 nt, Artificial Sequence
  derived and/or modified sequence opt2 from Vantictumab_HeavyChain1
gagguccagcucgucgaguccggcggcggccucguccagcccggcggcucccuccgccucuccugcgccgccuccggcuucaccuucucccacuacacccucuccuggguccgccaggcccccggcaagggccucgagugggucuccgucaucuccggcgacggcuccuacaccuacuacgccgacuccgucaagggccgcuucaccaucuccuccgacaacuccaagaacacccucuaccuccagaugaacucccuccgcgccgaggacaccgccgucuacuacugcgcccgcaacuucaucaaguacgucuucgccaacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16203 - RNA, 639 nt, Artificial Sequence
  derived and/or modified sequence opt2 from Vantictumab_LightChain1
gacaucgagcucacccagccccccuccgucuccgucgcccccggccagaccgcccgcaucuccugcuccggcgacaacaucggcuccuucuacguccacugguaccagcagaagcccggccaggcccccguccucgucaucuacgacaaguccaaccgccccuccggcauccccgagcgcuucuccggcuccaacuccggcaacaccgccacccucaccaucuccggcacccaggccgaggacgaggccgacuacuacugccaguccuacgccaacacccucucccucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16204 - RNA, 1389 nt, Artificial Sequence
  derived and/or modified sequence opt2 from Vanucizumab_HeavyChain1
cagguccagcucguccaguccggcgccgaggucaagaagcccggcgccuccgucaaggucuccugcaaggccuccggcuacaccuucaccggcuacuacaugcacuggguccgccaggcccccggccagggccucgaguggaugggcuggaucaaccccaacuccggcggcaccaacuacgcccagaaguuccagggccgcgucaccaugacccgcgacaccuccaucuccaccgccuacauggagcucucccgccuccgcuccgacgacaccgccgucuacuacugcgcccgcucccccaaccccuacuacuacgacuccuccggcuacuacuaccccggcgccuucgacaucuggggccagggcaccauggucaccgucuccuccgccuccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucugcacccucccccccucccgcgacgagcucaccaagaaccaggucucccucuccugcgccgucaagggcuucuaccccuccgacaucgccgucgagugggaguccaacggccagcccgagaacaacuacaagaccaccccccccguccucgacuccgacggcuccuucuuccucgucuccaagcucaccgucgacaagucccgcuggcagcagggcaacgucuucuccugcuccgucaugcacgaggcccuccacaaccacuacacccagaagucccucucccucucccccggcaag

SEQ ID NO: 16205 - RNA, 1359 nt, Artificial Sequence
  derived and/or modified sequence opt2 from Vanucizumab_HeavyChain2
gagguccagcucgucgaguccggcggcggccucguccagcccggcggcucccuccgccucuccugcgccgccuccggcuacaccuucaccaacuacggcaugaacuggguccgccaggcccccggcaagggccucgagugggucggcuggaucaacaccuacaccggcgagcccaccuacgccgccgacuucaagcgccgcuucaccuucucccucgacaccuccaaguccaccgccuaccuccagaugaacucccuccgcgccgaggacaccgccgucuacuacugcgccaaguacccccacuacuacggcuccucccacugguacuucgacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccugccgcgacgagcucaccaagaaccaggucucccucuggugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16206 - RNA, 639 nt, Artificial Sequence
  derived and/or modified sequence opt2 from Vanucizumab_LightChain1
cagcccggccucacccagccccccuccgucuccgucgcccccggccagaccgcccgcaucaccugcggcggcaacaacaucggcuccaaguccguccacugguaccagcagaagcccggccaggcccccguccucgucgucuacgacgacuccgaccgccccuccggcauccccgagcgcuucuccggcuccaacuccggcaacaccgccacccucaccaucucccgcgucgaggccggcgacgaggccgacuacuacugccaggucugggacuccuccuccgaccacuacgucuucggcaccggcaccaaggucaccguccucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16207 - RNA, 642 nt, Artificial Sequence; identical to SEQ ID NO: 15368
  derived and/or modified sequence opt2 from Vanucizumab_LightChain2

SEQ ID NO: 16208 - RNA, 1356 nt, Artificial Sequence
  derived and/or modified sequence opt2 from Varlilumab_HeavyChain1
cagguccagcucgucgaguccggcggcggcgucguccagcccggccgcucccuccgccucuccugcgccgccuccggcuucaccuucuccuccuacgacaugcacuggguccgccaggcccccggcaagggccucgagugggucgccgucaucugguacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcggcuccggcaacuggggcuucuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagggcuccucc

SEQ ID NO: 16209 - RNA, 642 nt, Artificial Sequence
  derived and/or modified sequence opt2 from Varlilumab_LightChain1
gacauccagaugacccagucccccuccucccucuccgccuccgucggcgaccgcgucaccaucaccugccgcgccucccagggcaucucccgcuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacaacaccuacccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16210 - RNA, 1338 nt, Artificial Sequence
  derived and/or modified sequence opt2 from Vatelizumab_HeavyChain1
cagguccagcuccaggaguccggccccggccucgucaagcccuccgagacccucucccucaccugcaccgucuccggcuucucccucaccaacuacggcauccacuggauccgccagccccccggcaagggccucgaguggcucggcgucaucugggcccgcggcuucaccaacuacaacuccgcccucaugucccgccucaccaucuccaaggacaacuccaagaaccaggucucccucaagcucuccuccgucaccgccgccgacaccgccgucuacuacugcgcccgcgccaacgacggcgucuacuacgccauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16211 - RNA, 639 nt, Artificial Sequence
  derived and/or modified sequence opt2 from Vatelizumab_LightChain1
gacuucgucaugacccagucccccgccuuccucuccgucacccccggcgagaaggucaccaucaccugcuccgcccaguccuccgucaacuacauccacugguaccagcagaagcccgaccaggcccccaagaagcucaucuacgacaccuccaagcucgccuccggcguccccucccgcuucuccggcuccggcuccggcaccgacuacaccuucaccaucuccucccucgaggccgaggacgccgccaccuacuacugccagcaguggaccaccaacccccucaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16212 - RNA, 1353 nt, Artificial Sequence
  derived and/or modified sequence opt2 from Vedolizumab_HeavyChain1
cagguccagcucguccaguccggcgccgaggucaagaagcccggcgccuccgucaaggucuccugcaagggcuccggcuacaccuucaccuccuacuggaugcacuggguccgccaggcccccggccagcgccucgaguggaucggcgagaucgaccccuccgaguccaacaccaacuacaaccagaaguucaagggccgcgucacccucaccgucgacaucuccgccuccaccgccuacauggagcucuccucccuccgcuccgaggacaccgccgucuacuacugcgcccgcggcggcuacgacggcugggacuacgccaucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcucgccggcgcccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16213 - RNA, 657 nt, Artificial Sequence
  derived and/or modified sequence opt2 from Vedolizumab_LightChain1
gacgucgucaugacccaguccccccucucccuccccgucacccccggcgagcccgccuccaucuccugccgcuccucccagucccucgccaaguccuacggcaacaccuaccucuccugguaccuccagaagcccggccaguccccccagcuccucaucuacggcaucuccaaccgcuucuccggcguccccgaccgcuucuccggcuccggcuccggcaccgacuucacccucaagaucucccgcgucgaggccgaggacgucggcgucuacuacugccuccagggcacccaccagcccuacaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16214 - RNA, 1353 nt, Artificial Sequence
  derived and/or modified sequence opt2 from Veltuzumab_HeavyChain1
cagguccagcuccagcaguccggcgccgaggucaagaagcccggcuccuccgucaaggucuccugcaaggccuccggcuacaccuucaccuccuacaacaugcacugggucaagcaggcccccggccagggccucgaguggaucggcgccaucuaccccggcaugggcgacaccuccuacaaccagaaguucaagggcaaggccacccucaccgccgacgaguccaccaacaccgccuacauggagcucuccucccuccgcuccgaggacaccgccuucuacuacugcgcccgcuccaccuacuacggcggcgacugguacuucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16215 - RNA, 639 nt, Artificial Sequence
  derived and/or modified sequence opt2 from Veltuzumab_LightChain1
gacauccagcucacccagucccccuccucccucuccgccuccgucggcgaccgcgucaccaugaccugccgcgccuccuccuccgucuccuacauccacugguuccagcagaagcccggcaaggcccccaagcccuggaucuacgccaccuccaaccucgccuccggcguccccguccgcuucuccggcuccggcuccggcaccgacuacaccuucaccaucuccucccuccagcccgaggacaucgccaccuacuacugccagcaguggaccuccaacccccccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16216 - RNA, 1359 nt, Artificial Sequence
  derived and/or modified sequence opt2 from Vesencumab_HeavyChain1
gagguccagcucgucgaguccggcggcggccucguccagcccggcggcucccuccgccucuccugcgccgccuccggcuucaccuucuccuccuacgccauguccuggguccgccaggcccccggcaagggccucgagugggucucccagaucucccccgccggcggcuacaccaacuacgccgacuccgucaagggccgcuucaccaucuccgccgacaccuccaagaacaccgccuaccuccagaugaacucccuccgcgccgaggacaccgccgucuacuacugcgcccgcggcgagcuccccuacuaccgcauguccaaggucauggacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16217 - RNA, 642 nt, Artificial Sequence
  derived and/or modified sequence opt2 from Vesencumab_LightChain1
gacauccagaugacccagucccccuccucccucuccgccuccgucggcgaccgcgucaccaucaccugccgcgccucccaguacuucuccuccuaccucgccugguaccagcagaagcccggcaaggcccccaagcuccucaucuacggcgccuccucccgcgccuccggcguccccucccgcuucuccggcuccggcuccggcaccgacuucacccucaccaucuccucccuccagcccgaggacuucgccaccuacuacugccagcaguaccucggcuccccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16218 - RNA, 1338 nt, Artificial Sequence
  derived and/or modified sequence opt2 from Visilizumab_HeavyChain1
cagguccagcucguccaguccggcgccgaggucaagaagcccggcgccuccgucaaggucuccugcaaggccuccggcuacaccuucaucuccuacaccaugcacuggguccgccaggcccccggccagggccucgaguggaugggcuacaucaacccccgcuccggcuacacccacuacaaccagaagcucaaggacaaggccacccucaccgccgacaaguccgccuccaccgccuacauggagcucuccucccuccgcuccgaggacaccgccgucuacuacugcgcccgcuccgccuacuacgacuacgacggcuucgccuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgccgccgcccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccuccaag

SEQ ID NO: 16219 - RNA, 639 nt, Artificial Sequence
  derived and/or modified sequence opt2 from Visilizumab_LightChain1
gacauccagaugacccagucccccuccucccucuccgccuccgucggcgaccgcgucaccaucaccugcuccgccuccuccuccgucuccuacaugaacugguaccagcagaagcccggcaaggcccccaagcgccucaucuacgacaccuccaagcucgccuccggcguccccucccgcuucuccggcuccggcuccggcaccgacuucacccucaccaucuccucccuccagcccgaggacuucgccaccuacuacugccagcagugguccuccaacccccccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16220 - RNA, 1353 nt, Artificial Sequence
  derived and/or modified sequence opt2 from Volociximab_HeavyChain
cagguccagcucaaggaguccggccccggccucgucgcccccucccagucccucuccaucaccugcaccaucuccggcuucucccucaccgacuacggcguccacuggguccgccagccccccggcaagggccucgaguggcucgucgucaucugguccgacggcuccuccaccuacaacuccgcccucaagucccgcaugaccauccgcaaggacaacuccaagucccaggucuuccucaucaugaacucccuccagaccgacgacuccgccauguacuacugcgcccgccacggcaccuacuacggcaugaccaccaccggcgacgcccucgacuacuggggccagggcaccuccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugccccuccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16221 - RNA, 645 nt, Artificial Sequence
  derived and/or modified sequence opt2 from Volociximab_LightChain
cagaucguccucacccagucccccgccaucauguccgccucccucggcgagcgcgucaccaugaccugcaccgccuccuccuccgucuccuccaacuaccuccacugguaccagcagaagcccggcuccgcccccaaccucuggaucuacuccaccuccaaccucgccuccggcguccccgcccgcuucuccggcuccggcuccggcaccuccuacucccucaccaucuccuccauggaggccgaggacgccgccaccuacuacugccaccaguaccuccgcuccccccccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16222 - RNA, 1344 nt, Artificial Sequence
  derived and/or modified sequence opt2 from Vorsetuzumab_HeavyChain1
cagguccagcucguccaguccggcgccgaggucaagaagcccggcgccuccgucaaggucuccugcaaggccuccggcuacaccuucaccaacuacggcaugaacuggguccgccaggcccccggccagggccucaaguggaugggcuggaucaacaccuacaccggcgagcccaccuacgccgacgccuucaagggccgcgucaccaugacccgcgacaccuccaucuccaccgccuacauggagcucucccgccuccgcuccgacgacaccgccgucuacuacugcgcccgcgacuacggcgacuacggcauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16223 - RNA, 654 nt, Artificial Sequence
  derived and/or modified sequence opt2 from Vorsetuzumab_LightChain1
gacaucgucaugacccagucccccgacucccucgccgucucccucggcgagcgcgccaccaucaacugccgcgccuccaaguccgucuccaccuccggcuacuccuucaugcacugguaccagcagaagcccggccagccccccaagcuccucaucuaccucgccuccaaccucgaguccggcguccccgaccgcuucuccggcuccggcuccggcaccgacuucacccucaccaucuccucccuccaggccgaggacgucgccgucuacuacugccagcacucccgcgagguccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16224 - RNA, 1344 nt, Artificial Sequence; identical to SEQ ID NO: 16222
  derived and/or modified sequence opt2 from Vorsetuzumab_mafodotin_HeavyChain1

SEQ ID NO: 16225 - RNA, 654 nt, Artificial Sequence; identical to SEQ ID NO: 16223
  derived and/or modified sequence opt2 from Vorsetuzumab_mafodotin_LightChain1

SEQ ID NO: 16226 - RNA, 1347 nt, Artificial Sequence; identical to SEQ ID NO: 15448
  derived and/or modified sequence opt2 from Yttrium_(90Y)_clivatuzumab_tetraxetan_HeavyChain1

SEQ ID NO: 16227 - RNA, 645 nt, Artificial Sequence; identical to SEQ ID NO: 15449
  derived and/or modified sequence opt2 from Yttrium_(90Y)_clivatuzumab_tetraxetan_LightChain1

SEQ ID NO: 16228 - RNA, 1338 nt, Artificial Sequence
  derived and/or modified sequence opt2 from Yttrium_Y_90_epratuzumab_tetraxetan_HeavyChain1
cagguccagcucguccaguccggcgccgaggucaagaagcccggcuccuccgucaaggucuccugcaaggccuccggcuacaccuucaccuccuacuggcuccacuggguccgccaggcccccggccagggccucgaguggaucggcuacaucaacccccgcaacgacuacaccgaguacaaccagaacuucaaggacaaggccaccaucaccgccgacgaguccaccaacaccgccuacauggagcucuccucccuccgcuccgaggacaccgccuucuacuucugcgcccgccgcgacaucaccaccuucuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16229 - RNA, 657 nt, Artificial Sequence
  derived and/or modified sequence opt2 from Yttrium_Y_90_epratuzumab_tetraxetan_LightChain1
gacauccagcucacccagucccccuccucccucuccgccuccgucggcgaccgcgucaccauguccugcaaguccucccaguccguccucuacuccgccaaccacaagaacuaccucgccugguaccagcagaagcccggcaaggcccccaagcuccucaucuacugggccuccacccgcgaguccggcguccccucccgcuucuccggcuccggcuccggcaccgacuucaccuucaccaucuccucccuccagcccgaggacaucgccaccuacuacugccaccaguaccucuccuccuggaccuucggcggcggcaccaagguccagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16230 - RNA, 1326 nt, Artificial Sequence
  derived and/or modified sequence opt2 from Yttrium_Y_90_epratuzumab_HeavyChain1
cagguccagcucguccaguccggcgccgaggucaagaagcccggcuccuccgucaaggucuccugcaaggccuccggcuacaccuucaccuccuacuggcuccacuggguccgccaggcccccggccagggccucgaguggaucggcuacaucaacccccgcaacgacuacaccgaguacaaccagaacuucaaggacaaggccaccaucaccgccgacgaguccaccaacaccgccuacgagcucuccucccuccgcuccgaggacaccgccuucuacuucugcgcccgccgcgacaucaccaccuucuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccacgaggcccuccacaaccacuacacccagaagucccucucccucucccccggcaag

SEQ ID NO: 16231 - RNA, 654 nt, Artificial Sequence
  derived and/or modified sequence opt2 from Yttrium_Y_90_epratuzumab_LightChain1
gacauccagcucacccagucccccuccucccucuccgccuccgucggcgaccgcgucaccuccugcaaguccucccaguccguccucuacuccgccaaccacaagaacuaccucgccugguaccagcagaagcccggcaaggcccccaagcuccucaucuacugggccuccacccgcgaguccggcguccccucccgcuucuccggcuccggcuccggcaccgacuucaccuucaccaucuccucccuccagcccgaggacaucgccaccuacuacugccaccaguaccucuccuccuggaccuucggcggcggcaccaagguccagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16232 - RNA, 1365 nt, Artificial Sequence
  derived and/or modified sequence opt2 from Zalutumumab_HeavyChain1
cagguccagcucgucgaguccggcggcggcgucguccagcccggccgcucccuccgccucuccugcgccgccuccggcuucaccuucuccaccuacggcaugcacuggguccgccaggcccccggcaagggccucgagugggucgccgucaucugggacgacggcuccuacaaguacuacggcgacuccgucaagggccgcuucaccaucucccgcgacaacuccaagaacacccucuaccuccagaugaacucccuccgcgccgaggacaccgccgucuacuacugcgcccgcgacggcaucaccaugguccgcggcgucaugaaggacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16233 - RNA, 642 nt, Artificial Sequence
  derived and/or modified sequence opt2 from Zalutumumab_LightChain1
gccauccagcucacccagucccccuccucccucuccgccuccgucggcgaccgcgucaccaucaccugccgcgccucccaggacaucuccuccgcccucgucugguaccagcagaagcccggcaaggcccccaagcuccucaucuacgacgccuccucccucgaguccggcguccccucccgcuucuccggcuccgaguccggcaccgacuucacccucaccaucuccucccuccagcccgaggacuucgccaccuacuacugccagcaguucaacuccuacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16234 - RNA, 1332 nt, Artificial Sequence
  derived and/or modified sequence opt2 from Zanolimumab_H0_HeavyChain
cagguccagcuccagcaguggggcgccggccuccucaagcccuccgagacccucucccucaccugcgccgucuacggcggcuccuucuccggcuacuacugguccuggauccgccagccccccggcaagggccucgaguggaucggcgagaucaaccacuccggcuccaccaacuacaaccccucccucaagucccgcgucaccaucuccgucgacaccuccaagaaccaguucucccucaagcucuccuccgucaccgccgccgacaccgccgucuacuacugcgcccgcgucaucaacugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccuggaccguccccuccuccucccucggcacccagaccuacaucugcaacgucaacuucaucaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucugggacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16235 - RNA, 642 nt, Artificial Sequence
  derived and/or modified sequence opt2 from Zanolimumab_L0_LightChain
gacauccagaugacccagucccccuccuccgucuccgccuccgucggcgaccgcgucaccaucaccugccgcgccucccaggacaucuccuccuggcucgccgucgucuaccagcacaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuuccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguucaaccgcggcgagugc

SEQ ID NO: 16236 - RNA, 1344 nt, Artificial Sequence; identical to SEQ ID NO: 15855
  derived and/or modified sequence opt2 from Zatuximab_HeavyChain1

SEQ ID NO: 16237 - RNA, 657 nt, Artificial Sequence; identical to SEQ ID NO: 15856
  derived and/or modified sequence opt2 from Zatuximab_LightChain1

SEQ ID NO: 16238 - RNA, 1356 nt, Artificial Sequence
  derived and/or modified sequence opt2 from Actoxumab_HeavyChain
cagguccagcucgucgaguccggcggcggcgucguccagcccggccgcucccuccgccucuccugcgccgccuccggcuucuccuucuccaacuacggcaugcacuggguccgccaggcccccggcaagggccucgagugggucgcccucaucugguacgacggcuccaacgaggacuacaccgacuccgucaagggccgcuucaccaucucccgcgacaacuccaagaacacccucuaccuccagaugaacucccuccgcgccgaggacaccgccgucuacuacugcgcccgcuggggcaugguccgcggcgucaucgacgucuucgacaucuggggccagggcaccgucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16239 - RNA, 642 nt, Artificial Sequence
  derived and/or modified sequence opt2 from Actoxumab_LightChain
gacauccagaugacccagucccccuccuccgucuccgccuccgucggcgaccgcgucaccaucaccugccgcgccucccagggcaucuccuccuggcucgccugguaccagcacaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaggccaacuccuuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16240 - RNA, 1326 nt, Artificial Sequence
  derived and/or modified sequence opt2 from Andecaliximab_HeavyChain
cagguccagcuccaggaguccggccccggccucgucaagcccuccgagacccucucccucaccugcaccgucuccggcuucucccuccucuccuacggcguccacuggguccgccagccccccggcaagggccucgaguggcucggcgucaucuggaccggcggcaccaccaacuacaacuccgcccucaugucccgcuucaccaucuccaaggacgacuccaagaacaccgucuaccucaagaugaacucccucaagaccgaggacaccgccaucuacuacugcgcccgcuacuacuacggcauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16241 - RNA, 642 nt, Artificial Sequence
  derived and/or modified sequence opt2 from Andecaliximab_LightChain
gacauccagaugacccagucccccuccucccucuccgccuccgucggcgaccgcgucaccaucaccugcaaggccucccaggacguccgcaacaccgucgccugguaccagcagaagcccggcaaggcccccaagcuccucaucuacuccuccuccuaccgcaacaccggcguccccgaccgcuucuccggcuccggcuccggcaccgacuucacccucaccaucuccucccuccaggccgaggacgucgccgucuacuacugccagcagcacuacaucacccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16242 - RNA, 1353 nt, Artificial Sequence
  derived and/or modified sequence opt2 from Aprutumab_HeavyChain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccgccaucuccggcuccggcaccuccaccuacuacgccgacuccgucaagggccgcuucaccaucucccgcgacaacuccaagaacacccucuaccuccagaugaacucccuccgcgccgaggacaccgccgucuacuacugcgcccgcguccgcuacaacuggaaccacggcgacugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16243 - RNA, 648 nt, Artificial Sequence
  derived and/or modified sequence opt2 from Aprutumab_LightChain
caguccguccucacccagccccccuccgccuccggcacccccggccagcgcgucaccaucuccugcuccggcuccuccuccaacaucggcaacaacuacgucuccugguaccagcagcuccccggcaccgcccccaagcuccucaucuacgagaacuacaaccgccccgccggcguccccgaccgcuucuccggcuccaaguccggcaccuccgccucccucgccaucuccggccuccgcuccgaggacgaggccgacuacuacugcuccuccugggacgacucccucaacuacugggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16244 - RNA, 1341 nt, Artificial Sequence
  derived and/or modified sequence opt2 from Azintuxizumab_HeavyChain
gagguccagcucgucgaguccggcggcggccucguccagcccggcggcucccuccgccucuccugcgccgccuccggcuucaccuucuccgacuacuacauggccuggguccgccaggcccccggcaagggccucgagugggucgccuccaucaacuacgacggcuccuccaccuacuacgucgacuccgucaagggccgcuucaccaucucccgcgacaacgccaagaacucccucuaccuccagaugaacucccuccgcgccgaggacaccgccgucuacuacugcgcccgcgaccgcggcuacuacuucgacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16245 - RNA, 660 nt, Artificial Sequence
  derived and/or modified sequence opt2 from Azintuxizumab_LightChain
gacgucgucaugacccagaccccccucucccucuccgucacccccggccagcccgccuccaucuccugccgcuccucccagucccucguccacuccaacggcaacaccuaccuccacugguaccuccagaagcccggccaguccccccagcuccucaucuacaaggucuccaaccgcuucuccggcguccccgaccgcuucuccggcuccggcuccggcaccgacuucacccucaagaucucccgcgucgaggccgaggacgucggcgucuacuucugcucccaguccacccacgucccccccuucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16246 - RNA, 366 nt, Artificial Sequence
  derived and/or modified sequence opt2 from Blinatumomab_HeavyChain1
cagguccagcuccagcaguccggcgccgagcucguccgccccggcuccuccgucaagaucuccugcaaggccuccggcuacgccuucuccuccuacuggaugaacugggucaagcagcgccccggccagggccucgaguggaucggccagaucuggcccggcgacggcgacaccaacuacaacggcaaguucaagggcaaggccacccucaccgccgacgaguccuccuccaccgccuacaugcagcucuccucccucgccuccgaggacuccgccgucuacuucugcgcccgccgcgagaccaccaccgucggccgcuacuacuacgccauggacuacuggggccagggcaccaccgucaccguc

SEQ ID NO: 16247 - RNA, 363 nt, Artificial Sequence
  derived and/or modified sequence opt2 from Blinatumomab_HeavyChain2
gacaucaagcuccagcaguccggcgccgagcucgcccgccccggcgccuccgucaagauguccugcaagaccuccggcuacaccuucacccgcuacaccaugcacugggucaagcagcgccccggccagggccucgaguggaucggcuacaucaaccccucccgcggcuacaccaacuacaaccagaaguucaaggacaaggccacccucaccaccgacaaguccuccuccaccgccuacaugcagcucuccucccucaccuccgaggacuccgccgucuacuacugcgcccgcuacuacgacgaccacuacugccucgacuacuggggccagggcaccacccucaccgucuccuccgucgag

SEQ ID NO: 16248 - RNA, 1494 nt, Artificial Sequence
  derived and/or modified sequence opt2 from Blinatumomab_LightChain_HeavyChain_HeavyChain_LightChain
gacauccagcucacccagucccccgccucccucgccgucucccucggccagcgcgccaccaucuccugcaaggccucccaguccgucgacuacgacggcgacuccuaccucaacugguaccagcagauccccggccagccccccaagcuccucaucuacgacgccuccaaccucgucuccggcauccccccccgcuucuccggcuccggcuccggcaccgacuucacccucaacauccaccccgucgagaaggucgacgccgccaccuaccacugccagcaguccaccgaggaccccuggaccuucggcggcggcaccaagcucgagaucaagggcggcggcggcuccggcggcggcggcuccggcggcggcggcucccagguccagcuccagcaguccggcgccgagcucguccgccccggcuccuccgucaagaucuccugcaaggccuccggcuacgccuucuccuccuacuggaugaacugggucaagcagcgccccggccagggccucgaguggaucggccagaucuggcccggcgacggcgacaccaacuacaacggcaaguucaagggcaaggccacccucaccgccgacgaguccuccuccaccgccuacaugcagcucuccucccucgccuccgaggacuccgccgucuacuucugcgcccgccgcgagaccaccaccgucggccgcuacuacuacgccauggacuacuggggccagggcaccaccgucaccgucuccuccggcggcggcggcuccgacaucaagcuccagcaguccggcgccgagcucgcccgccccggcgccuccgucaagauguccugcaagaccuccggcuacaccuucacccgcuacaccaugcacugggucaagcagcgccccggccagggccucgaguggaucggcuacaucaaccccucccgcggcuacaccaacuacaaccagaaguucaaggacaaggccacccucaccaccgacaaguccuccuccaccgccuacaugcagcucuccucccucaccuccgaggacuccgccgucuacuacugcgcccgcuacuacgacgaccacuacugccucgacuacuggggccagggcaccacccucaccgucuccuccgucgagggcggcuccggcggcuccggcggcuccggcggcuccggcggcgucgacgacauccagcucacccagucccccgccaucauguccgccucccccggcgagaaggucaccaugaccugccgcgccuccuccuccgucuccuacaugaacugguaccagcagaaguccggcaccucccccaagcgcuggaucuacgacaccuccaaggucgccuccggcguccccuaccgcuucuccggcuccggcuccggcaccuccuacucccucaccaucuccuccauggaggccgaggacgccgccaccuacuacugccagcagugguccuccaacccccucaccuucggcgccggcaccaagcucgagcucaag

SEQ ID NO: 16249 - RNA, 333 nt, Artificial Sequence
  derived and/or modified sequence opt2 from Blinatumomab_LightChain1
gacauccagcucacccagucccccgccucccucgccgucucccucggccagcgcgccaccaucuccugcaaggccucccaguccgucgacuacgacggcgacuccuaccucaacugguaccagcagauccccggccagccccccaagcuccucaucuacgacgccuccaaccucgucuccggcauccccccccgcuucuccggcuccggcuccggcaccgacuucacccucaacauccaccccgucgagaaggucgacgccgccaccuaccacugccagcaguccaccgaggaccccuggaccuucggcggcggcaccaagcucgagaucaag

SEQ ID NO: 16250 - RNA, 324 nt, Artificial Sequence
  derived and/or modified sequence opt2 from Blinatumomab_LightChain2
gucgacgacauccagcucacccagucccccgccaucauguccgccucccccggcgagaaggucaccaugaccugccgcgccuccuccuccgucuccuacaugaacugguaccagcagaaguccggcaccucccccaagcgcuggaucuacgacaccuccaaggucgccuccggcguccccuaccgcuucuccggcuccggcuccggcaccuccuacucccucaccaucuccuccauggaggccgaggacgccgccaccuacuacugccagcagugguccuccaacccccucaccuucggcgccggcaccaagcucgagcucaag

SEQ ID NO: 16251 - RNA, 1350 nt, Artificial Sequence
  derived and/or modified sequence opt2 from Brazikumab_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucugguacgacggcuccaacgaguacuacgccgacuccgucaagggccgcuucaccaucucccgcgacaacuccaagaacacccucuaccuccagaugaacucccuccgcgccgaggacaccgccgucuacuacugcgcccgcgaccgcggcuacaccuccuccugguaccccgacgccuucgacaucuggggccagggcaccauggucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16252 - RNA, 651 nt, Artificial Sequence
  derived and/or modified sequence opt2 from Brazikumab_LightChain
caguccguccucacccagccccccuccgucuccggcgcccccggccagcgcgucaccaucuccugcaccggcuccuccuccaacaccggcgccggcuacgacguccacugguaccagcagguccccggcaccgcccccaagcuccucaucuacggcuccggcaaccgccccuccggcguccccgaccgcuucuccggcuccaaguccggcaccuccgccucccucgccaucaccggccuccaggccgaggacgaggccgacuacuacugccaguccuacgacuccucccucuccggcugggucuucggcggcggcacccgccucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16253 - RNA, 363 nt, Artificial Sequence
  derived and/or modified sequence opt2 from Brolucizumab_HeavyChain
uccgagguccagcucgucgaguccggcggcggccucguccagcccggcggcucccuccgccucuccugcaccgccuccggcuucucccucaccgacuacuacuacaugaccuggguccgccaggcccccggcaagggccucgagugggucggcuucaucgaccccgacgacgaccccuacuacgccaccugggccaagggccgcuucaccaucucccgcgacaacuccaagaacacccucuaccuccagaugaacucccuccgcgccgaggacaccgccgucuacuacugcgccggcggcgaccacaacuccggcuggggccucgacaucuggggccagggcacccucgucaccgucuccucc

SEQ ID NO: 16254 - RNA, 333 nt, Artificial Sequence
  derived and/or modified sequence opt2 from Brolucizumab_LightChain
auggagaucgucaugacccagucccccuccacccucuccgccuccgucggcgaccgcgucaucaucaccugccaggccuccgagaucauccacuccuggcucgccugguaccagcagaagcccggcaaggcccccaagcuccucaucuaccucgccuccacccucgccuccggcguccccucccgcuucuccggcuccggcuccggcgccgaguucacccucaccaucuccucccuccagcccgacgacuucgccaccuacuacugccagaacgucuaccucgccuccaccaacggcgccaacuucggccagggcaccaagcucaccguccuc

SEQ ID NO: 16255 - RNA, 1347 nt, Artificial Sequence
  derived and/or modified sequence opt2 from Cabiralizumab_HeavyChain
cagguccagcucguccaguccggcgccgaggucaagaagcccggcuccuccgucaaggucuccugcaaggccuccggcuacaccuucaccgacaacuacaugaucuggguccgccaggcccccggccagggccucgaguggaugggcgacaucaaccccuacaacggcggcaccaccuucaaccagaaguucaagggccgcgucaccaucaccgccgacaaguccaccuccaccgccuacauggagcucuccucccuccgcuccgaggacaccgccgucuacuacugcgcccgcgagucccccuacuucuccaaccucuacgucauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16256 - RNA, 654 nt, Artificial Sequence
  derived and/or modified sequence opt2 from Cabiralizumab_LightChain
gagaucguccucacccagucccccgccacccucucccucucccccggcgagcgcgccacccucuccugcaaggccucccaguccgucgacuacgacggcgacaacuacaugaacugguaccagcagaagcccggccaggccccccgccuccucaucuacgccgccuccaaccucgaguccggcauccccgcccgcuucuccggcuccggcuccggcaccgacuucacccucaccaucuccucccucgagcccgaggacuucgccgucuacuacugccaccucuccaacgaggaccucuccaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16257 - RNA, 1329 nt, Artificial Sequence
  derived and/or modified sequence opt2 from Camrelizumab_HeavyChain
gagguccagcucgucgaguccggcggcggccucguccagcccggcggcucccuccgccucuccugcgccgccuccggcuucaccuucuccuccuacaugauguccuggguccgccaggcccccggcaagggccucgagugggucgccaccaucuccggcggcggcgccaacaccuacuaccccgacuccgucaagggccgcuucaccaucucccgcgacaacgccaagaacucccucuaccuccagaugaacucccuccgcgccgaggacaccgccgucuacuacugcgcccgccagcucuacuacuucgacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16258 - RNA, 642 nt, Artificial Sequence
  derived and/or modified sequence opt2 from Camrelizumab_LightChain
gacauccagaugacccagucccccuccucccucuccgccuccgucggcgaccgcgucaccaucaccugccucgccucccagaccaucggcaccuggcucaccugguaccagcagaagcccggcaaggcccccaagcuccucaucuacaccgccaccucccucgccgacggcguccccucccgcuucuccggcuccggcuccggcaccgacuucacccucaccaucuccucccuccagcccgaggacuucgccaccuacuacugccagcaggucuacuccauccccuggaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16259 - RNA, 777 nt, Artificial Sequence; identical to SEQ ID NO: 15426
  derived and/or modified sequence opt2 from Caplacizumab_HeavyChain

SEQ ID NO: 16260 - RNA, 657 nt, Artificial Sequence
  derived and/or modified sequence opt2 from Citatuzumab_bogatox_HeavyChain
gagguccagcucguccaguccggccccggccucguccagcccggcggcuccguccgcaucuccugcgccgccuccggcuacaccuucaccaacuacggcaugaacugggucaagcaggcccccggcaagggccucgaguggaugggcuggaucaacaccuacaccggcgaguccaccuacgccgacuccuucaagggccgcuucaccuucucccucgacaccuccgccuccgccgccuaccuccagaucaacucccuccgcgccgaggacaccgccgucuacuacugcgcccgcuucgccaucaagggcgacuacuggggccagggcacccuccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16261 - RNA, 1356 nt, Artificial Sequence
  derived and/or modified sequence opt2 from Cosfroviximab_HeavyChain
gacgucaagcuccucgaguccggcggcggccucguccagcccggcggcucccucaagcucuccugcgccgccuccggcuucucccucuccaccuccggcgucggcgucggcugguuccgccagcccuccggcaagggccucgaguggcucgcccucaucuggugggacgacgacaaguacuacaaccccucccucaagucccagcucuccaucuccaaggacuucucccgcaaccaggucuuccucaagaucuccaacgucgacaucgccgacaccgccaccuacuacugcgcccgccgcgaccccuucggcuacgacaacgccaugggcuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16262 - RNA, 639 nt, Artificial Sequence
  derived and/or modified sequence opt2 from Cosfroviximab_LightChain
gacaucgucaugacccaguccccccucucccucuccaccuccgucggcgaccgcgucucccucaccugcaaggccucccagaacgucggcaccgccgucgccugguaccagcagaagcccggccagucccccaagcuccucaucuacuccgccuccaaccgcuacaccggcguccccgaccgcuucaccggcuccggcuccggcaccgacuucacccucaccaucuccaacaugcaguccgaggaccucgccgacuacuucugccagcaguacuccuccuacccccucaccuucggcgccggcaccaagcucgagcuccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16263 - RNA, 1344 nt, Artificial Sequence
  derived and/or modified sequence opt2 from Crizanlizumab_HeavyChain
cagguccagcucguccaguccggcgccgaggucaagaagcccggcgccuccgucaaggucuccugcaaggucuccggcuacaccuucaccuccuacgacaucaacuggguccgccaggcccccggcaagggccucgaguggaugggcuggaucuaccccggcgacggcuccaucaaguacaacgagaaguucaagggccgcgucaccaugaccgucgacaaguccaccgacaccgccuacauggagcucuccucccuccgcuccgaggacaccgccgucuacuacugcgcccgccgcggcgaguacggcaacuacgagggcgccauggacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccgucaccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcauggagguccacaacgccaagaccaagccccgcgaggagcaguucaacuccaccuuccgcgucgucuccguccucaccgucguccaccaggacuggcucaacggcaaggaguacaagugcgccgucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16264 - RNA, 654 nt, Artificial Sequence
  derived and/or modified sequence opt2 from Crizanlizumab_LightChain
gacauccagaugacccagucccccuccucccucuccgccuccgucggcgaccgcgucaccaucaccugcaaggccucccaguccgucgacuacgacggccacuccuacaugaacugguaccagcagaagcccggcaaggcccccaagcuccucaucuacgccgccuccaaccucgaguccggcguccccucccgcuucuccggcuccggcuccggcaccgacuucacccucaccaucuccucccuccagcccgaggacuucgccaccuacuacugccagcaguccgacgagaacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16265 - RNA, 1365 nt, Artificial Sequence
  derived and/or modified sequence opt2 from Crotedumab_HeavyChain
gagguccagcucgucgaguccggcggcggccucguccagcccggcggcucccuccgccucuccugcgccgccuccggcuucaccuucuccaacuaccucaugaacuggguccgccaggcccccggcaagggccucgaguggcucgccaacauccaggaggacggcaucgagaaguacuacgucgacuccgucaagggccgcuucaccaucucccgcgacaacgccaagaacucccucuaccuccagaugaacucccuccgcgccgaggacaccgccgucuacuacugcgcccgcgagcccucccacuacgacauccucaccggcuacgacuacuacuacggcauggacgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16266 - RNA, 642 nt, Artificial Sequence
  derived and/or modified sequence opt2 from Crotedumab_LightChain
gacauccagaugacccagucccccuccucccucuccgccuccgucggcgaccgcgucaccaucaccugccgcgccucccagggcauccgcaacgaccucggcugguaccagcagaagcccggcaaggcccccaagcgccucaucuacgccgccuccucccuccaguccggcguccccucccgcuucuccggcuccggcuccggcaccgaguucauccucaccgucuccucccuccagcccgaggacuucgccaccuacuacugccuccaguacaacuccaaccccuucaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16267 - RNA, 1356 nt, Artificial Sequence
  derived and/or modified sequence opt2 from Dezamizumab_HeavyChain
cagguccagcucguccaguccggcgccgaggucaagaagcccggcuccuccgucaaggucuccugcaaggccuccggcuucaccuucgccaccuacaacaugcacuggguccgccaggcccccggccagggccucgaguggaugggcuacaucuaccccggcgacggcaacgccaacuacaaccagcaguucaagggccgcgucaccaucaccgccgacaaguccaccuccaccgccuacauggagcucuccucccuccgcuccgaggacaccgccgucuacuacugcgcccgcggcgacuucgacuacgacggcggcuacuacuucgacuccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16268 - RNA, 642 nt, Artificial Sequence
  derived and/or modified sequence opt2 from Dezamizumab_LightChain
gacauccagaugacccagucccccuccucccucuccgccuccgucggcgaccgcgucaccaucaccugccgcgccuccgagaacaucuacuccuaccucgccugguaccagcagaagcccggcaaggcccccaagcuccucauccacaacgccaagacccucgccgagggcguccccucccgcuucuccggcuccggcuccggcaccgacuucacccucaccaucuccucccuccagcccgaggacuucgccaccuacuacugccagcaccacuacggcgccccccucaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16269 - RNA, 1506 nt, Artificial Sequence
  derived and/or modified sequence opt2 from Duvortuxizumab_Chain1_scFv
gagaacguccucacccagucccccgccacccucuccgucacccccggcgagaaggccaccaucaccugccgcgccucccaguccgucuccuacaugcacugguaccagcagaagcccggccaggccccccgccuccucaucuacgacgccuccaaccgcgccuccggcguccccucccgcuucuccggcuccggcuccggcaccgaccacacccucaccaucuccucccucgaggccgaggacgccgccaccuacuacugcuuccagggcuccgucuaccccuucaccuucggccagggcaccaagcucgagaucaagggcggcggcuccggcggcggcggcgagguccagcucgucgaguccggcggcggccucguccagcccggcggcucccuccgccucuccugcgccgccuccggcuucaccuucuccaccuacgccaugaacuggguccgccaggcccccggcaagggccucgagugggucggccgcauccgcuccaaguacaacaacuacgccaccuacuacgccgacuccgucaagggccgcuucaccaucucccgcgacgacuccaagaacucccucuaccuccagaugaacucccucaagaccgaggacaccgccgucuacuacugcguccgccacggcaacuucggcaacuccuacgucuccugguucgccuacuggggccagggcacccucgucaccgucuccuccgccuccaccaagggcgaggucgccgccugcgagaaggaggucgccgcccucgagaaggaggucgccgcccucgagaaggaggucgccgcccucgagaagggcggcggcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucuggugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16270 - RNA, 813 nt, Artificial Sequence
  derived and/or modified sequence opt2 from Duvortuxizumab_Chain2_scFv
caggccgucgucacccaggagcccucccucaccgucucccccggcggcaccgucacccucaccugccgcuccuccaccggcgccgucaccaccuccaacuacgccaacuggguccagcagaagcccggccaggccccccgcggccucaucggcggcaccaacaagcgcgcccccuggacccccgcccgcuucuccggcucccuccucggcggcaaggccgcccucaccaucaccggcgcccaggccgaggacgaggccgacuacuacugcgcccucugguacuccaaccucugggucuucggcggcggcaccaagcucaccguccucggcggcggcggcuccggcggcggcggccaggucacccuccgcgaguccggccccgcccucgucaagcccacccagacccucacccucaccugcaccuucuccggcuucucccucuccaccuccggcaugggcgucggcuggauccgccagccccccggcaaggcccucgaguggcucgcccacaucuggugggacgacgacaagcgcuacaaccccgcccucaagucccgccucaccaucuccaaggacaccuccaagaaccaggucuuccucaccaugaccaacauggaccccgucgacaccgccaccuacuacugcgcccgcauggagcucugguccuacuacuucgacuacuggggccagggcaccaccgucaccgucuccuccgccuccaccaagggcaaggucgccgccugcaaggagaaggucgccgcccucaaggagaaggucgccgcccucaaggagaaggucgccgcccucaaggag

SEQ ID NO: 16271 - RNA, 681 nt, Artificial Sequence
  derived and/or modified sequence opt2 from Duvortuxizumab_Chain3_h-CH2-CH3
gacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucuccugcgccgucaagggcuucuaccccuccgacaucgccgucgagugggaguccaacggccagcccgagaacaacuacaagaccaccccccccguccucgacuccgacggcuccuucuuccucgucuccaagcucaccgucgacaagucccgcuggcagcagggcaacgucuucuccugcuccgucaugcacgaggcccuccacaaccgcuacacccagaagucccucucccucucccccggcaag

SEQ ID NO: 16272 - RNA, 360 nt, Artificial Sequence
  derived and/or modified sequence opt2 from Efungumab_HeavyChain
auggccgagguccagcucgucgaguccggcgccgaggucaagaagcccggcgagucccuccgcaucuccugcaagggcuccggcugcaucaucuccuccuacuggaucuccuggguccgccagaugcccggcaagggccucgaguggaugggcaagaucgaccccggcgacuccuacaucaacuacucccccuccuuccagggccacgucaccaucuccgccgacaaguccaucaacaccgccuaccuccaguggaacucccucaaggccuccgacaccgccauguacuacugcgcccgcggcggccgcgacuucggcgacuccuucgacuacuggggccagggcacccucgucaccguc

SEQ ID NO: 16273 - RNA, 750 nt, Artificial Sequence
  derived and/or modified sequence opt2 from Efungumab_HeavyChain_LightChain
auggccgagguccagcucgucgaguccggcgccgaggucaagaagcccggcgagucccuccgcaucuccugcaagggcuccggcugcaucaucuccuccuacuggaucuccuggguccgccagaugcccggcaagggccucgaguggaugggcaagaucgaccccggcgacuccuacaucaacuacucccccuccuuccagggccacgucaccaucuccgccgacaaguccaucaacaccgccuaccuccaguggaacucccucaaggccuccgacaccgccauguacuacugcgcccgcggcggccgcgacuucggcgacuccuucgacuacuggggccagggcacccucgucaccgucuccuccggcggcggcggcuccggcggcggcggcuccggcggcggcggcuccgacgucgucaugacccagucccccuccuuccucuccgccuucgucggcgaccgcaucaccaucaccugccgcgccuccuccggcaucucccgcuaccucgccugguaccagcaggcccccggcaaggcccccaagcuccucaucuacgccgccuccacccuccagaccggcguccccucccgcuucuccggcuccggcuccggcaccgaguucacccucaccaucaacucccuccagcccgaggacuucgccaccuacuacugccagcaccucaacuccuacccccucaccuucggcggcggcaccaaggucgacaucaagcgcgccgccgcccucgag

SEQ ID NO: 16274 - RNA, 339 nt, Artificial Sequence
  derived and/or modified sequence opt2 from Efungumab_LightChain
gacgucgucaugacccagucccccuccuuccucuccgccuucgucggcgaccgcaucaccaucaccugccgcgccuccuccggcaucucccgcuaccucgccugguaccagcaggcccccggcaaggcccccaagcuccucaucuacgccgccuccacccuccagaccggcguccccucccgcuucuccggcuccggcuccggcaccgaguucacccucaccaucaacucccuccagcccgaggacuucgccaccuacuacugccagcaccucaacuccuacccccucaccuucggcggcggcaccaaggucgacaucaagcgcgccgccgcccucgag

SEQ ID NO: 16275 - RNA, 1350 nt, Artificial Sequence
  derived and/or modified sequence opt2 from Elezanumab_HeavyChain
gagguccagcucguccaguccggcgccgaggucaagaagcccggcgccuccgucaaggucuccugcaaggccuccggcuacaccuucaccucccacggcaucuccuggguccgccaggcccccggccagggccucgacuggaugggcuggaucucccccuacuccggcaacaccaacuacgcccagaagcuccagggccgcgucaccaugaccaccgacaccuccaccuccaccgccuacauggagcucuccucccuccgcuccgaggacaccgccgucuacuacugcgcccgcgucggcuccggccccuacuacuacauggacgucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggaccagcucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccguccuccacgaggcccuccacaaccacuacacccagaagucccucucccucucccccggcaag

SEQ ID NO: 16276 - RNA, 645 nt, Artificial Sequence
  derived and/or modified sequence opt2 from Elezanumab_LightChain
caguccgcccucacccagccccgcuccgucuccggcucccccggccaguccgucaccaucuccugcaccggcaccuccuccuccgucggcgacuccaucuacgucuccugguaccagcagcaccccggcaaggcccccaagcucaugcucuacgacgucaccaagcgccccuccggcguccccgaccgcuucuccggcuccaaguccggcaacaccgccucccucaccaucuccggccuccaggccgaggacgaggccgacuacuacugcuacuccuacgccggcaccgacacccucuucggcggcggcaccaaggucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16277 - RNA, 1359 nt, Artificial Sequence
  derived and/or modified sequence opt2 from Emapalumab_HeavyChain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucuccgccaucuccggcuccggcggcuccaccuacuacgccgacuccgucaagggccgcuucaccaucucccgcgacaacuccaagaacacccucuaccuccagaugaacucccuccgcgccgaggacaccgccgucuacuacugcgccaaggacggcuccuccggcugguacgucccccacugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16278 - RNA, 651 nt, Artificial Sequence
  derived and/or modified sequence opt2 from Emapalumab_LightChain
aacuucaugcucacccagccccacuccgucuccgagucccccggcaagaccgucaccaucuccugcacccgcuccuccggcuccaucgccuccaacuacguccagugguaccagcagcgccccggcuccucccccaccaccgucaucuacgaggacaaccagcgccccuccggcguccccgaccgcuucuccggcuccaucgacuccuccuccaacuccgccucccucaccaucuccggccucaagaccgaggacgaggccgacuacuacugccaguccuacgacggcuccaaccgcuggauguucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16279 - RNA, 1341 nt, Artificial Sequence
  derived and/or modified sequence opt2 from Enoblituzumab_HeavyChain
caggucgagcucgucgaguccggcggcggccucguccagcccggcggcucccuccgccucuccugcgccgccuccggcuucaccuucaccuccuacuggauguccuggguccgccaggcccccggcaagggccucgagcucgucuccuccaucaccuccuacggcuccuucaccuacuacgccgacuccgucaagggccgcuucaccaucucccgcgacaacuccaagaacacccucuaccuccagaugaacucccuccgcgccgaggacaccgccgucuacuacugcgcccgcaacauguacacccacuucgacuccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16280 - RNA, 648 nt, Artificial Sequence
  derived and/or modified sequence opt2 from Enoblituzumab_LightChain
gacaucguccucacccagccccccuccgucuccggcgcccccggccagcgcgucaccaucuccugcuccggcuccuccuccaacaucggcuccaacuccgucuccugguaccagcagcuccccggcaccgcccccaagcuccucaucuacgacaacuccaagcgccccuccggcguccccgaccgcuucuccggcuccaaguccggcaccuccgccucccucgccaucaccggccuccaguccgaggacgaggccgacuacuacugccagucccgcgacaccuacggcuacuacugggucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaagggcgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16281 - RNA, 1323 nt, Artificial Sequence
  derived and/or modified sequence opt2 from Eptinezumab_HeavyChain
gagguccagcucgucgaguccggcggcggccucguccagcccggcggcucccuccgccucuccugcgccgucuccggcaucgaccucuccggcuacuacaugaacuggguccgccaggcccccggcaagggccucgagugggucggcgucaucggcaucaacggcgccaccuacuacgccuccugggccaagggccgcuucaccaucucccgcgacaacuccaagaccaccgucuaccuccagaugaacucccuccgcgccgaggacaccgccgucuacuucugcgcccgcggcgacaucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacgcccgcgucgagcccaaguccugcgacaagacccacaccugcccccccugccccgcccccgagcuccucggcggccccuccgucacccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacgccuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16282 - RNA, 657 nt, Artificial Sequence
  derived and/or modified sequence opt2 from Eptinezumab_LightChain
cagguccucacccagucccccuccucccucuccgccuccgucggcgaccgcgucaccaucaacugccaggccucccaguccgucuaccacaacaccuaccucgccugguaccagcagaagcccggcaagguccccaagcagcucaucuacgacgccuccacccucgccuccggcguccccucccgcuucuccggcuccggcuccggcaccgacuucacccucaccaucuccucccuccagcccgaggacgucgccaccuacuacugccucggcuccuacgacugcaccaacggcgacugcuucgucuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16283 - RNA, 1368 nt, Artificial Sequence
  derived and/or modified sequence opt2 from Erenumab_HeavyChain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccuucgacggcuccaucaaguacuccgucgacuccgucaagggccgcuucaccaucucccgcgacaacuccaagaacacccucuuccuccagaugaacucccuccgcgccgaggacaccgccgucuacuacugcgcccgcgaccgccucaacuacuacgacuccuccggcuacuaccacuacaaguacuacggcauggccgucuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16284 - RNA, 648 nt, Artificial Sequence
  derived and/or modified sequence opt2 from Erenumab_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaagcgccccuccggcauccccgaccgcuucuccggcuccaaguccggcaccuccaccacccucggcaucaccggccuccagaccggcgacgaggccgacuacuacugcggcaccugggacucccgccucuccgccgucgucuucggcggcggcaccaagcucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16285 - RNA, 1344 nt, Artificial Sequence
  derived and/or modified sequence opt2 from Fremanezumab_HeavyChain
gagguccagcucgucgaguccggcggcggccucguccagcccggcggcucccuccgccucuccugcgccgccuccggcuucaccuucuccaacuacuggaucuccuggguccgccaggcccccggcaagggccucgagugggucgccgagauccgcuccgaguccgacgccuccgccacccacuacgccgaggccgucaagggccgcuucaccaucucccgcgacaacgccaagaacucccucuaccuccagaugaacucccuccgcgccgaggacaccgccgucuacuacugccucgccuacuucgacuacggccucgccauccagaacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16286 - RNA, 642 nt, Artificial Sequence
  derived and/or modified sequence opt2 from Fremanezumab_LightChain
gagaucguccucacccagucccccgccacccucucccucucccccggcgagcgcgccacccucuccugcaaggccuccaagcgcgucaccaccuacgucuccugguaccagcagaagcccggccaggccccccgccuccucaucuacggcgccuccaaccgcuaccucggcauccccgcccgcuucuccggcuccggcuccggcaccgacuucacccucaccaucuccucccucgagcccgaggacuucgccgucuacuacugcucccaguccuacaacuaccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16287 - RNA, 1371 nt, Artificial Sequence
  derived and/or modified sequence opt2 from Frunevetmab_HeavyChain
cagguccagcucgucgaguccggcgccgagcucguccagcccggcgagucccuccgccucaccugcgccgccuccggcuucucccucaccaacaacaacgucaacuggguccgccaggcccccggcaagggccucgaguggaugggcggcgucugggccggcggcgccaccgacuacaacuccgcccucaagucccgccucaccaucacccgcgacaccuccaagaacaccgucuuccuccagaugcacucccuccaguccgaggacaccgccaccuacuacugcgcccgcgacggcggcuacuccuccuccacccucuacgccauggacgccuggggccagggcaccaccgucaccgucuccgccgccuccaccaccgcccccuccgucuucccccucgcccccuccugcggcaccaccuccggcgccaccgucgcccucgccugccucguccucggcuacuuccccgagcccgucaccgucuccuggaacuccggcgcccucaccuccggcguccacaccuuccccgccguccuccaggccuccggccucuacucccucuccuccauggucaccguccccuccucccgcuggcucuccgacaccuucaccugcaacgucgcccacccccccuccaacaccaaggucgacaagaccguccgcaagaccgaccacccccccggccccaagcccugcgacugccccaagugccccccccccgagaugcucggcggccccuccaucuucaucuucccccccaagcccaaggacacccucuccaucucccgcacccccgaggucaccugccucgucgucgaccucggccccgacgacuccgacguccagaucaccugguucgucgacaacacccaggucuacaccgccaagaccuccccccgcgaggagcaguucaacuccaccuaccgcgucgucuccguccuccccauccuccaccaggacuggcucaagggcaaggaguucaagugcaaggucaacuccaagucccuccccucccccaucgagcgcaccaucuccaaggccaagggccagccccacgagccccaggucuacguccucccccccgcccaggaggagcucucccgcaacaaggucuccgucaccugccucaucaaguccuuccacccccccgacaucgccgucgagugggagaucaccggccagcccgagcccgagaacaacuaccgcaccacccccccccagcucgacuccgacggcaccuacuucgucuacuccaagcucuccgucgaccgcucccacuggcagcgcggcaacaccuacaccugcuccgucucccacgaggcccuccacucccaccacacccagaagucccucacccagucccccggcaag

SEQ ID NO: 16288 - RNA, 651 nt, Artificial Sequence
  derived and/or modified sequence opt2 from Frunevetmab_LightChain
gacaucgagaugacccaguccccccucucccucuccgucacccccggcgaguccgucuccaucuccugccgcgccuccgaggacaucuacaacgcccucgccugguaccuccagaagcccggccgcuccccccgccuccucaucuacaacaccgacacccuccacaccggcguccccgaccgcuucuccggcuccggcuccggcaccgacuucacccucaagaucucccgcguccagaccgaggacgucggcgucuacuucugccagcacuacuuccacuacccccgcaccuucggccagggcaccaagcucgagcucaagcgcuccgacgcccagcccuccgucuuccucuuccagcccucccucgacgagcuccacaccggcuccgccuccaucgucugcauccucaacgacuucuaccccaaggaggucaacgucaaguggaaggucgacggcgucguccagaacaagggcauccaggaguccaccaccgagcagaacuccaaggacuccaccuacucccucuccuccacccucaccauguccuccaccgaguaccagucccacgagaaguucuccugcgaggucacccacaagucccucgccuccacccucgucaaguccuucaaccgcuccgagugccagcgcgag

SEQ ID NO: 16289 - RNA, 1341 nt, Artificial Sequence
  derived and/or modified sequence opt2 from Gatipotuzumab_HeavyChain
gagguccagcucgucgaguccggcggcggccucguccagcccggcggcuccaugcgccucuccugcgucgccuccggcuuccccuucuccaacuacuggaugaacuggguccgccaggcccccggcaagggccucgagugggucggcgagauccgccucaaguccaacaacuacaccacccacuacgccgaguccgucaagggccgcuucaccaucucccgcgacgacuccaagaacucccucuaccuccagaugaacucccucaagaccgaggacaccgccgucuacuacugcacccgccacuacuacuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 16290 - RNA, 657 nt, Artificial Sequence
  derived and/or modified sequence opt2 from Gatipotuzumab_LightChain
gacaucgucaugacccaguccccccucuccaaccccgucacccccggcgagcccgccuccaucuccugccgcuccuccaagucccuccuccacuccaacggcaucaccuacuucuucugguaccuccagaagcccggccaguccccccagcuccucaucuaccagauguccaaccucgccuccggcguccccgaccgcuucuccggcuccggcuccggcaccgacuucacccuccgcaucucccgcgucgaggccgaggacgucggcgucuacuacugcgcccagaaccucgagcucccccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16291 - RNA, 1365 nt, Artificial Sequence
  derived and/or modified sequence opt2 from Gedivumab_HeavyChain
gagguccagcucgucgaguccggcggcggcgucguccagcccggcaagucccuccgccucuccugcgccgccuccggccucaccuucuccuccuacgccguccacuggguccgccaggcccccggcaagggccucgagugggucacccucaucuccuacgacggcgccaaccaguacuacgccgacuccgucaagggccgcuucaccaucucccgcgacaacuccaagaacaccgucuaccuccagaugaacucccuccgccccgaggacaccgccgucuacuacugcgccguccccggccccgucuucggcaucuucccccccugguccuacuucgacaacuggggccagggcauccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16292 - RNA, 648 nt, Artificial Sequence
  derived and/or modified sequence opt2 from Gedivumab_LightChain
gagaucguccucacccagucccccgccacccucuccgucucccccggcgagcgcgccacccucuccugccgcgccucccaggucaucucccacaaccucgccugguaccagcagaagcccggccaggccccccgccuccucaucuacggcgccuccacccgcgccuccggcauccccgcccgcuucuccggcuccggcuccggcaccgacuacacccucaccaucaccucccuccaguccgaggacuucgccgucuacuacugccagcacuacuccaacuggcccccccgccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16293 - RNA, 1329 nt, Artificial Sequence
  derived and/or modified sequence opt2 from Gemetuzumab_HeavyChain
gagguccagcucguccaguccggcgccgaggucaagaagcccggcuccuccgucaaggucuccugcaaggccuccggcuacaccaucaccgacuccaacauccacuggguccgccaggcccccggccagucccucgaguggaucggcuacaucuaccccuacaacggcggcaccgacuacaaccagaaguucaagaaccgcgccacccucaccgucgacaaccccaccaacaccgccuacauggagcucuccucccuccgcuccgaggacaccgccuucuacuacugcgucaacggcaaccccuggcucgccuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16294 - RNA, 654 nt, Artificial Sequence
  derived and/or modified sequence opt2 from Gemetuzumab_LightChain
gacauccagcucacccagucccccuccacccucuccgccuccgucggcgaccgcgucaccaucaccugccgcgccuccgagucccucgacaacuacggcauccgcuuccucaccugguuccagcagaagcccggcaaggcccccaagcuccucauguacgccgccuccaaccagggcuccggcguccccucccgcuucuccggcuccggcuccggcaccgaguucacccucaccaucuccucccuccagcccgacgacuucgccaccuacuacugccagcagaccaaggagguccccugguccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16295 - RNA, 1365 nt, Artificial Sequence
  derived and/or modified sequence opt2 from Gilvetmab_HeavyChain
gagguccagcucguccaguccggcggcgaccucgucaagcccggcggcuccguccgccucuccugcgucgccuccggcuucaacaucaagaacaccuacaugcacuggguccgccaggcccccggcaagggccuccaguggaucggccgcaucgcccccgccaacgucgacaccaaguacgcccccaaguuccagggcaaggccaccaucuccgccgacaccgccaagaacaccgccuacaugcagcucaacucccuccgcgccgaggacaccgccgucuacuacugcguccucaucuacuacgacuacgacggcgacaucgacgucuggggccagggcacccucgucaccgucuccuccgccuccaccaccgcccccuccgucuucccccucgcccccuccugcggcuccaccuccggcuccaccgucgcccucgccugccucgucuccggcuacuuccccgagcccgucaccgucuccuggaacuccggcucccucaccuccggcguccacaccuuccccuccguccuccaguccuccggccucuacucccucuccuccauggucaccguccccuccucccgcuggcccuccgagaccuucaccugcaacgucgcccaccccgccuccaagaccaaggucgacaagcccguccccaagcgcgagaacggccgcgucccccgcccccccgacugccccaagugccccgcccccgagaugcucggcggccccuccgucuucaucuucccccccaagcccaaggacacccuccucaucgcccgcacccccgaggucaccugcgucgucgucgcccucgaccccgaggaccccgagguccagaucuccugguucgucgacggcaagcagaugcagaccgccaagacccagccccgcgaggagcaguucgccggcaccuaccgcgucgucuccguccuccccaucggccaccaggacuggcucaagggcaagcaguucaccugcaaggucaacaacaaggcccuccccucccccaucgagcgcaccaucuccaaggcccgcggccaggcccaccagcccuccgucuacguccucccccccucccgcgaggagcucuccaagaacaccgucucccucaccugccucaucaaggacuucuucccccccgacaucgacgucgaguggcaguccaacggccagcaggagcccgaguccaaguaccgcaccacccccccccagcucgacgaggacggcuccuacuuccucuacuccaagcucuccgucgacaagucccgcuggcagcgcggcgacaccuucaucugcgccgucaugcacgaggcccuccacaaccacuacacccaggagucccucucccacucccccggcaag

SEQ ID NO: 16296 - RNA, 654 nt, Artificial Sequence
  derived and/or modified sequence opt2 from Gilvetmab_LightChain
gacaucgucaugacccagaccccccucucccucuccgucucccucggcgagcccgccuccaucuccugccacgccucccagaacaucaacgucuggcucuccugguaccgccagaagcccggccagaucccccagcuccucaucuacaaggccucccaccuccacaccggcguccccgaccgcuucuccggcuccggcuccggcaccgacuucacccuccgcaucucccgcgucgaggccgacgacgccggcgucuacuacugccagcagggccaguccuggccccucaccuucggccagggcaccaaggucgagaucaagcgcaacgacgcccagcccgccgucuaccucuuccagcccucccccgaccagcuccacaccggcuccgccuccgucgucugccuccucaacuccuucuaccccaaggacaucaacgucaaguggaaggucgacggcgucauccaggacaccggcauccaggaguccgucaccgagcaggacuccaaggacuccaccuacucccucuccuccacccucaccauguccuccaccgaguaccucucccacgagcucuacuccugcgagaucacccacaagucccuccccuccacccucaucaaguccuuccagcgcuccgagugccagcgcgucgac

SEQ ID NO: 16297 - RNA, 1344 nt, Artificial Sequence; identical to SEQ ID NO: 15580
  derived and/or modified sequence opt2 from Ifabotuzumab_HeavyChain

SEQ ID NO: 16298 - RNA, 642 nt, Artificial Sequence; identical to SEQ ID NO: 15581
  derived and/or modified sequence opt2 from Ifabotuzumab_LightChain

SEQ ID NO: 16299 - RNA, 1323 nt, Artificial Sequence
  derived and/or modified sequence opt2 from Iratumumab_HeavyChain
cagguccagcuccagcaguggggcgccggccuccucaagcccuccgagacccucucccucaccugcgccgucuacggcggcuccuucuccgccuacuacugguccuggauccgccagccccccggcaagggccucgaguggaucggcgacaucaaccacggcggcggcaccaacuacaaccccucccucaagucccgcgucaccaucuccgucgacaccuccaagaaccaguucucccucaagcucaacuccgucaccgccgccgacaccgccgucuacuacugcgccucccucaccgccuacuggggccagggcucccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacacccagaagucccucucccucucccccggcaag

SEQ ID NO: 16300 - RNA, 642 nt, Artificial Sequence
  derived and/or modified sequence opt2 from Iratumumab_LightChain
gacauccagaugacccagucccccaccucccucuccgccuccgucggcgaccgcgucaccaucaccugccgcgccucccagggcaucuccuccuggcucaccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacgacuccuaccccaucaccuucggccagggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16301 - RNA, 1344 nt, Artificial Sequence
  derived and/or modified sequence opt2 from Lacnotuzumab_HeavyChain
cagguccagcuccaggaguccggccccggccucgucaagcccucccagacccucucccucaccugcaccgucuccgacuacuccaucaccuccgacuacgccuggaacuggauccgccaguuccccggcaagggccucgaguggaugggcuacaucuccuacuccggcuccaccuccuacaaccccucccucaagucccgcaucaccaucucccgcgacaccuccaagaaccaguucucccuccagcucaacuccgucaccgccgccgacaccgccgucuacuacugcgccuccuucgacuacgcccacgccauggacuacuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16302 - RNA, 642 nt, Artificial Sequence
  derived and/or modified sequence opt2 from Lacnotuzumab_LightChain
gacaucguccucacccagucccccgccuuccucuccgucacccccggcgagaaggucaccuucaccugccaggccucccaguccaucggcaccuccauccacugguaccagcagaagaccgaccaggcccccaagcuccucaucaaguacgccuccgaguccaucuccggcauccccucccgcuucuccggcuccggcuccggcaccgacuucacccucaccaucuccuccgucgaggccgaggacgccgccgacuacuacugccagcagaucaacuccuggcccaccaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16303 - RNA, 1347 nt, Artificial Sequence
  derived and/or modified sequence opt2 from Larcaviximab_HeavyChain
gagguccagcuccaggaguccggccccgagcucgagaugcccggcgccuccgucaagaucuccugcaaggccuccggcuccuccuucaccggcuucuccaugaacugggucaagcaguccaacggcaagucccucgaguggaucggcaacaucgacaccuacuacggcggcaccaccuacaaccagaaguucaagggcaaggccacccucaccgucgacaaguccuccuccaccgccuacaugcagcucaagucccucaccuccgaggacuccgccgucuacuacugcgcccgcuccgccuacuacggcuccaccuucgccuacuggggccagggcacccucgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16304 - RNA, 642 nt, Artificial Sequence
  derived and/or modified sequence opt2 from Larcaviximab_LightChain
gacauccagaugacccagucccccgccucccucuccgccuccgucggcgagaccgucaccaucaccugccgcgccuccgagaacaucuacuccuaccucgccugguaccagcagaagcagggcaaguccccccagcuccucgucuacaacgccaagacccucaucgagggcguccccucccgcuucuccggcuccggcuccggcacccaguucucccucaagaucaacucccuccagcccgaggacuucggcuccuacuucugccagcaccacuucggcacccccuucaccuucggcuccggcaccgagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16305 - RNA, 1338 nt, Artificial Sequence
  derived and/or modified sequence opt2 from Lendalizumab_HeavyChain
cagguccagcucguccaguccggcgccgaggucaagaagcccggcgccuccgucaaggucuccugcaaggccuccggcuacaccuucaccgacuacuccauggacuggguccgccaggcccccggccagggccucgaguggaugggcgccauccaccucaacaccggcuacaccaacuacaaccagaaguucaagggccgcgucaccaugacccgcgacaccuccaccuccaccgucuacauggagcucuccucccuccgcuccgaggacaccgccgucuacuacugcgcccgcggcuucuacgacggcuacucccccauggacuacuggggccagggcaccaccgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16306 - RNA, 654 nt, Artificial Sequence
  derived and/or modified sequence opt2 from Lendalizumab_LightChain
gacauccagaugacccagucccccuccucccucuccgccuccgucggcgaccgcgucaccaucaccugccgcgccuccgaguccgucgacuccuacggcaacuccuucaugcacugguaccagcagaagcccggcaaggcccccaagcuccucaucuaccgcgccuccaaccucgaguccggcguccccucccgcuucuccggcuccggcuccggcaccgacuucacccucaccaucuccucccuccagcccgaggacuucgccaccuacuacugccagcaguccaacgaggaccccuacaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16307 - RNA, 1359 nt, Artificial Sequence
  derived and/or modified sequence opt2 from Lesofavumab_HeavyChain
gagguccagcucguccaguccggcgccgaggucaagaagcccggcgagucccucaagaucuccugcaaggucuccggcuacuccuucaccucccaguggaucggcuggguccgccagaugcccggcaagggccucgaguggaucggcaugauguaccccggcgaguccgagaccaucuacucccccuccuuccagggccaggucaccaucuccgccgacaacuccaucuccaccgccuaccuccagugguccucccucaaggccuccgacaccgccaucuacuacugcgccuccggccccggcuacuccggcuaccacuacggcugguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16308 - RNA, 657 nt, Artificial Sequence
  derived and/or modified sequence opt2 from Lesofavumab_LightChain
gacaucgucaugacccaguccccccucucccuccccgucacccccggcgagcccgccuccaucuccugccgcuccucccagucccuccuccgcuccaacggcuacaacuaccucgacugguaccuccagaagcccggccaguccccccagcuccucaucuaccucggcuccaaccgcgccuccggcguccccgaccgcuucuccggcuccggcuccggcaccgacuucacccucaagaucucccgcgucgaggccgaggacgucggcgucuacuacugcaugcaggcccuccagacccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16309 - RNA, 1059 nt, Artificial Sequence
  derived and/or modified sequence opt2 from Letolizumab_HeavyChain
gagguccagcuccucgaguccggcggcggccucguccagcccggcggcucccuccgccucuccugcgccgccuccggcuucaccuucaacugggagcucaugggcugggcccgccaggcccccggcaagggccucgagugggucuccggcaucgagggccccggcgacgucaccuacuacgccgacuccgucaagggccgcuucaccaucucccgcgacaacuccaagaacacccucuaccuccagaugaacucccuccgcgccgaggacaccgccgucuacuacugcgucaaggucggcaaggacgccaaguccgacuaccgcggccagggcacccucgucaccgucuccuccgccuccaccgagcccaaguccuccgacaagacccacaccuccccccccucccccgcccccgagcuccucggcggcuccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16310 - RNA, 1338 nt, Artificial Sequence
  derived and/or modified sequence opt2 from Losatuxizumab_HeavyChain
gagguccagcuccaggaguccggccccggccucgucaagcccucccagacccucucccucaccugcaccgucuccggcuacuccaucucccgcgacuucgccuggaacuggauccgccagccccccggcaagggccucgaguggaugggcuacaucuccuacaacggcaacacccgcuaccagcccucccucaagucccgcaucaccaucucccgcgacaccuccaagaaccaguucuuccucaagcucaacuccgucaccgccgccgacaccgccaccuacuacugcgucaccgccucccgcggcuuccccuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16311 - RNA, 642 nt, Artificial Sequence; identical to SEQ ID NO: 15489
  derived and/or modified sequence opt2 from Losatuxizumab_LightChain

SEQ ID NO: 16312 - RNA, 1338 nt, Artificial Sequence
  derived and/or modified sequence opt2 from Lupartumab_HeavyChain
gagguccagcuccucgaguccggcggcggccucguccagcccggcggcucccuccgccucuccugcgccgccuccggcuucaccuucuccaacgccuggauguccuggguccgccaggcccccggcaagggccucgagugggucuccuacaucuccuccuccggcuccaccaucuacuacgccgacuccgucaagggccgcuucaccaucucccgcgacaacuccaagaacacccucuaccuccagaugaacucccuccgcgccgaggacaccgccgucuacuacugcgcccgcgagggccucugggccuucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16313 - RNA, 651 nt, Artificial Sequence
  derived and/or modified sequence opt2 from Lupartumab_LightChain
gaguccguccucacccagccccccuccgucuccggcgcccccggccagcgcgucaccaucuccugcaccggcuccuccuccaacaucggcgccggcuacgucguccacugguaccagcagcuccccggcaccgcccccaagcuccucaucuacgacaacaacaagcgccccuccggcguccccgaccgcuucuccggcuccaaguccggcaccuccgccucccucgccaucuccggccuccgcuccgaggacgaggccgacuacuacugcgccgccugggacgaccgccucaacggccccgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16314 - RNA, 1731 nt, Artificial Sequence
  derived and/or modified sequence opt2 from Lutikizumab_HeavyChain
gagguccagcucgucgaguccggcggcggcgucguccagcccggccgcucccuccgccucuccugcuccgccuccggcuucaucuucucccgcuacgacauguccuggguccgccaggcccccggcaagggccucgagugggucgccuacaucucccacggcggcgccggcaccuacuaccccgacuccgucaagggccgcuucaccaucucccgcgacaacuccaagaacacccucuuccuccagauggacucccuccgccccgaggacaccggcgucuacuucugcgcccgcggcggcgucaccaagggcuacuucgacgucuggggccagggcacccccgucaccgucuccuccgccuccaccaagggcccccagguccagcucgucgaguccggcggcggcgucguccagcccggccgcucccuccgccucuccugcaccgccuccggcuucaccuucuccauguucggcguccacuggguccgccaggcccccggcaagggccucgagugggucgccgccgucuccuacgacggcuccaacaaguacuacgccgaguccgucaagggccgcuucaccaucucccgcgacaacuccaagaacauccucuuccuccagauggacucccuccgccucgaggacaccgccgucuacuacugcgcccgcggccgccccaaggucgucauccccgccccccucgcccacuggggccagggcacccucgucaccuucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgaggccgccggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16315 - RNA, 981 nt, Artificial Sequence
  derived and/or modified sequence opt2 from Lutikizumab_LightChain
gacauccagaugacccagucccccuccucccucuccgccuccgucggcgaccgcgucaccaucaccugccgcgccuccggcaacauccacaacuaccucaccugguaccagcagacccccggcaaggcccccaagcuccucaucuacaacgccaagacccucgccgacggcguccccucccgcuucuccggcuccggcuccggcaccgacuacaccuucaccaucuccucccuccagcccgaggacaucgccaccuacuacugccagcacuucugguccauccccuacaccuucggccagggcaccaagcuccagaucacccgcaccgucgccgcccccgacauccagaugacccagucccccuccuccgucuccgccuccgucggcgaccgcgucaccaucaccugccgcgccucccagggcaucuccuccuggcucgccugguaccagcagaagcccggcaaggcccccaagcuccucaucuacgaggccuccaaccucgagaccggcguccccucccgcuucuccggcuccggcuccggcuccgacuucacccucaccaucuccucccuccagcccgaggacuucgccaccuacuacugccagcagaccuccuccuuccuccucuccuucggcggcggcaccaaggucgagcacaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16316 - RNA, 1341 nt, Artificial Sequence
  derived and/or modified sequence opt2 from Oleclumab_HeavyChain
gagguccagcuccucgaguccggcggcggccucguccagcccggcggcucccuccgccucuccugcgccgccuccggcuucaccuucuccuccuacgccuacuccuggguccgccaggcccccggcaagggccucgagugggucuccgccaucuccggcuccggcggccgcaccuacuacgccgacuccgucaagggccgcuucaccaucucccgcgacaacuccaagaacacccucuaccuccagaugaacucccuccgcgccgaggacaccgccgucuacuacugcgcccgccucggcuacggccgcgucgacgaguggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgaguucgagggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgccuccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16317 - RNA, 648 nt, Artificial Sequence
  derived and/or modified sequence opt2 from Oleclumab_LightChain
caguccguccucacccagccccccuccgccuccggcacccccggccagcgcgucaccaucuccugcuccggcucccucuccaacaucggccgcaaccccgucaacugguaccagcagcuccccggcaccgcccccaagcuccucaucuaccucgacaaccuccgccucuccggcguccccgaccgcuucuccggcuccaaguccggcaccuccgccucccucgccaucuccggccuccaguccgaggacgaggccgacuacuacugcgccaccugggacgacucccaccccggcuggaccuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16318 - RNA, 1449 nt, Artificial Sequence; identical to SEQ ID NO: 15933
  derived and/or modified sequence opt2 from Otlertuzumab_HeavyChain

SEQ ID NO: 16319 - RNA, 339 nt, Artificial Sequence
  derived and/or modified sequence opt2 from Ozoralizumab_HeavyChain
gagguccagcucgucgaguccggcggcggccucguccagcccggcggcucccuccgccucuccugcgccgccuccggcuucaccuucuccgacuacuggauguacuggguccgccaggcccccggcaagggccucgagugggucuccgagaucaacaccaacggccucaucaccaaguaccccgacuccgucaagggccgcuucaccaucucccgcgacaacgccaagaacacccucuaccuccagaugaacucccuccgccccgaggacaccgccgucuacuacugcgcccgcucccccuccggcuucaaccgcggccagggcacccucgucaccguc

SEQ ID NO: 16320 - RNA, 1089 nt, Artificial Sequence; identical to SEQ ID NO: 15938
  derived and/or modified sequence opt2 from Ozoralizumab_HeavyChain_HeavyChain_HeavyChain

SEQ ID NO: 16321 - RNA, 1494 nt, Artificial Sequence
  derived and/or modified sequence opt2 from Pasotuxizumab_HeavyChain_LightChain_HeavyChain_LightChain
cagguccagcucgucgaguccggcggcggccucgucaagcccggcgagucccuccgccucuccugcgccgccuccggcuucaccuucuccgacuacuacauguacuggguccgccaggcccccggcaagggccucgagugggucgccaucaucuccgacggcggcuacuacaccuacuacuccgacaucaucaagggccgcuucaccaucucccgcgacaacgccaagaacucccucuaccuccagaugaacucccucaaggccgaggacaccgccgucuacuacugcgcccgcggcuucccccuccuccgccacggcgccauggacuacuggggccagggcacccucgucaccgucuccuccggcggcggcggcuccggcggcggcggcuccggcggcggcggcuccgacauccagaugacccagucccccuccucccucuccgccuccgucggcgaccgcgucaccaucaccugcaaggccucccagaacgucgacaccaacgucgccugguaccagcagaagcccggccaggcccccaagucccucaucuacuccgccuccuaccgcuacuccgacguccccucccgcuucuccggcuccgccuccggcaccgacuucacccucaccaucuccuccguccaguccgaggacuucgccaccuacuacugccagcaguacgacuccuaccccuacaccuucggcggcggcaccaagcucgagaucaaguccggcggcggcggcuccgagguccagcucgucgaguccggcggcggccucguccagcccggcggcucccucaagcucuccugcgccgccuccggcuucaccuucaacaaguacgccaugaacuggguccgccaggcccccggcaagggccucgagugggucgcccgcauccgcuccaaguacaacaacuacgccaccuacuacgccgacuccgucaaggaccgcuucaccaucucccgcgacgacuccaagaacaccgccuaccuccagaugaacaaccucaagaccgaggacaccgccgucuacuacugcguccgccacggcaacuucggcaacuccuacaucuccuacugggccuacuggggccagggcacccucgucaccgucuccuccggcggcggcggcuccggcggcggcggcuccggcggcggcggcucccagaccgucgucacccaggagcccucccucaccgucucccccggcggcaccgucacccucaccugcggcuccuccaccggcgccgucaccuccggcaacuaccccaacuggguccagcagaagcccggccaggccccccgcggccucaucggcggcaccaaguuccucgcccccggcacccccgcccgcuucuccggcucccuccucggcggcaaggccgcccucacccucuccggcguccagcccgaggacgaggccgaguacuacugcguccucugguacuccaaccgcugggucuucggcggcggcaccaagcucaccguccuc

SEQ ID NO: 16322 - RNA, 357 nt, Artificial Sequence
  derived and/or modified sequence opt2 from Pasotuxizumab_HeavyChain1
cagguccagcucgucgaguccggcggcggccucgucaagcccggcgagucccuccgccucuccugcgccgccuccggcuucaccuucuccgacuacuacauguacuggguccgccaggcccccggcaagggccucgagugggucgccaucaucuccgacggcggcuacuacaccuacuacuccgacaucaucaagggccgcuucaccaucucccgcgacaacgccaagaacucccucuaccuccagaugaacucccucaaggccgaggacaccgccgucuacuacugcgcccgcggcuucccccuccuccgccacggcgccauggacuacuggggccagggcacccucgucaccguc

SEQ ID NO: 16323 - RNA, 369 nt, Artificial Sequence
  derived and/or modified sequence opt2 from Pasotuxizumab_HeavyChain2
gagguccagcucgucgaguccggcggcggccucguccagcccggcggcucccucaagcucuccugcgccgccuccggcuucaccuucaacaaguacgccaugaacuggguccgccaggcccccggcaagggccucgagugggucgcccgcauccgcuccaaguacaacaacuacgccaccuacuacgccgacuccgucaaggaccgcuucaccaucucccgcgacgacuccaagaacaccgccuaccuccagaugaacaaccucaagaccgaggacaccgccgucuacuacugcguccgccacggcaacuucggcaacuccuacaucuccuacugggccuacuggggccagggcacccucgucaccguc

SEQ ID NO: 16324 - RNA, 321 nt, Artificial Sequence
  derived and/or modified sequence opt2 from Pasotuxizumab_LightChain1
gacauccagaugacccagucccccuccucccucuccgccuccgucggcgaccgcgucaccaucaccugcaaggccucccagaacgucgacaccaacgucgccugguaccagcagaagcccggccaggcccccaagucccucaucuacuccgccuccuaccgcuacuccgacguccccucccgcuucuccggcuccgccuccggcaccgacuucacccucaccaucuccuccguccaguccgaggacuucgccaccuacuacugccagcaguacgacuccuaccccuacaccuucggcggcggcaccaagcucgagaucaag

SEQ ID NO: 16325 - RNA, 327 nt, Artificial Sequence
  derived and/or modified sequence opt2 from Pasotuxizumab_LightChain2
cagaccgucgucacccaggagcccucccucaccgucucccccggcggcaccgucacccucaccugcggcuccuccaccggcgccgucaccuccggcaacuaccccaacuggguccagcagaagcccggccaggccccccgcggccucaucggcggcaccaaguuccucgcccccggcacccccgcccgcuucuccggcucccuccucggcggcaaggccgcccucacccucuccggcguccagcccgaggacgaggccgaguacuacugcguccucugguacuccaaccgcugggucuucggcggcggcaccaagcucaccguccuc

SEQ ID NO: 16326 - RNA, 1023 nt, Artificial Sequence; identical to SEQ ID NO: 15982
  derived and/or modified sequence opt2 from Placulumab_HeavyChain

SEQ ID NO: 16327 - RNA, 1353 nt, Artificial Sequence
  derived and/or modified sequence opt2 from Porgaviximab_HeavyChain
gagguccagcuccaggaguccggcggcggccucaugcagcccggcggcuccaugaagcucuccugcgucgccuccggcuucaccuucuccaacuacuggaugaacuggguccgccagucccccgagaagggccucgagugggucgccgagauccgccucaaguccaacaacuacgccacccacuacgccgaguccgucaagggccgcuucaccaucucccgcgacgacuccaagcgcuccgucuaccuccagaugaacacccuccgcgccgaggacaccggcaucuacuacugcacccgcggcaacggcaacuaccgcgccauggacuacuggggccagggcaccuccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16328 - RNA, 642 nt, Artificial Sequence
  derived and/or modified sequence opt2 from Porgaviximab_LightChain
gacauccagaugacccagucccccgccucccucuccgucuccgucggcgagaccgucuccaucaccugccgcgccuccgagaacaucuacuccucccucgccugguaccagcagaagcagggcaaguccccccagcuccucgucuacuccgccaccauccucgccgacggcguccccucccgcuucuccggcuccggcuccggcacccaguacucccucaagaucaacucccuccaguccgaggacuucggcaccuacuacugccagcacuucuggggcacccccuacaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16329 - RNA, 1341 nt, Artificial Sequence
  derived and/or modified sequence opt2 from Prezalumab_HeavyChain
gagguccagcucgucgaguccggcggcggccucguccagcccggcggcucccuccgccucuccugcgccgccuccggcuucaccuucuccuccuacuggauguccuggguccgccaggcccccggcaagggccucgagugggucgccuacaucaagcaggacggcaacgagaaguacuacgucgacuccgucaagggccgcuucaccaucucccgcgacaacgccaagaacucccucuaccuccagaugaacucccuccgcgccgaggacaccgccgucuacuacugcgcccgcgagggcauccucugguucggcgaccuccccaccuucuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16330 - RNA, 642 nt, Artificial Sequence
  derived and/or modified sequence opt2 from Prezalumab_LightChain
gacauccagaugacccagucccccuccucccucuccgccuccgucggcgaccgcgucaccaucaccugccgcgccucccagggcaucuccaacuggcucgccugguaccagcagaagcccgagaaggcccccaagucccucaucuacgccgccuccucccuccaguccggcguccccucccgcuucuccggcuccggcuccggcaccgacuucacccucaccaucuccucccuccagcccgaggacuucgccaccuacuacugccagcaguacgacuccuacccccgcaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16331 - RNA, 342 nt, Artificial Sequence
  derived and/or modified sequence opt2 from Radretumab_HeavyChain
gagguccagcuccucgaguccggcggcggccucguccagcccggcggcucccuccgccucuccugcgccgccuccggcuucaccuucuccuccuucuccauguccuggguccgccaggcccccggcaagggccucgagugggucuccuccaucuccggcuccuccggcaccaccuacuacgccgacuccgucaagggccgcuucaccaucucccgcgacaacuccaagaacacccucuaccuccagaugaacucccuccgcgccgaggacaccgccgucuacuacugcgccaagcccuuccccuacuucgacuacuggggccagggcacccucgucaccguc

SEQ ID NO: 16332 - RNA, 1071 nt, Artificial Sequence; identical to SEQ ID NO: 16001
  derived and/or modified sequence opt2 from Radretumab_HeavyChain_LightChain

SEQ ID NO: 16333 - RNA, 693 nt, Artificial Sequence
  derived and/or modified sequence opt2 from Radretumab_LightChain
gccuccgagaucguccucacccagucccccggcacccucucccucucccccggcgagcgcgccacccucuccugccgcgccucccaguccgucuccuccuccuuccucgccugguaccagcagaagcccggccaggccccccgccuccucaucuacuacgccuccucccgcgccaccggcauccccgaccgcuucuccggcuccggcuccggcaccgacuucacccucaccaucucccgccucgagcccgaggacuucgccgucuacuacugccagcagaccggccgcaucccccccaccuucggccagggcaccaaggucgagaucaaguccggcggcuccggcggcccccgcgccgcccccgaggucuacgccuucgccacccccgaguggcccggcucccgcgacaagcgcacccucgccugccucauccagaacuucaugcccgaggacaucuccguccaguggcuccacaacgagguccagcuccccgacgcccgccacuccaccacccagccccgcaagaccaagggcuccggcuucuucgucuucucccgccucgaggucacccgcgccgagugggagcagaaggacgaguucaucugccgcgccguccacgaggccgccucccccucccagaccguccagcgcgccgucuccgucaaccccgaguccucccgccgcggcggcugc

SEQ ID NO: 16334 - RNA, 1359 nt, Artificial Sequence
  derived and/or modified sequence opt2 from Ranevetmab_HeavyChain1
gagguccagcucgucgaguccggcggcggccucguccagcccggcggcucccuccgccucuccugcgucgccuccggcuucucccucaccaacaacaacgucaacuggguccgccaggcccccggcaagggccucgagugggucggcggcgucugggccggcggcgccaccgacuacaacuccgcccucaagucccgcuucaccaucucccgcgacaacgccaagaacaccgucuuccuccagaugcacucccuccgcuccgaggacaccgccgucuacuacugcgcccgcgacggcggcuacuccuccuccacccucuacgccauggacgccuggggccagggcaccuccgucaccgucuccuccgccuccaccaccgcccccuccgucuucccccucgcccccuccugcggcuccaccuccggcuccaccgucgcccucgccugccucgucuccggcuacuuccccgagcccgucaccgucuccuggaacuccggcucccucaccuccggcguccacaccuuccccuccguccuccaguccuccggccuccacucccucuccuccauggucaccguccccuccucccgcuggcccuccgagaccuucaccugcaacgucguccaccccgccuccaacaccaaggucgacaagcccgucuucaacgagugccgcugcaccgacaccccccccugccccguccccgagccccucggcggccccuccguccucaucuucccccccaagcccaaggacauccuccgcaucacccgcacccccgaggucaccugcgucguccucgaccucggccgcgaggaccccgagguccagaucuccugguucgucgacggcaaggaggucaucaccgccaagacccagucccgcgagcagcaguucaacggcaccuaccaggucgucuccguccuccccaucgagcaccaggacuggcucaccggcaaggaguucaagugccgcgucaaccacaucgaccuccccucccccaucgagcgcaccaucuccaaggcccgcggccgcgcccacaagcccuccgucuacguccucccccccucccccaaggagcucuccuccuccgacaccgucuccaucaccugccucaucaaggacuucuacccccccgacaucgacgucgaguggcaguccgucggccagcaggagcccgagcgcaagcaccgcaugacccccccccagcucgacgaggacggcuccuacuuccucuacuccaagcucuccgucgacaagucccgcuggcagcagggcgaccccuucaccugcgccgucaugcacgagacccuccagaaccacuacaccgaccucucccucucccacucccccggcaag

SEQ ID NO: 16335 - RNA, 1359 nt, Artificial Sequence
  derived and/or modified sequence opt2 from Ranevetmab_HeavyChain2
gagguccagcucgucgaguccggcggcggccucguccagcccggcggcucccuccgccucuccugcgucgccuccggcuucucccucaccaacaacaacgucaacuggguccgccaggcccccggcaagggccucgagugggucggcggcgucugggccggcggcgccaccgacuacaacuccgcccucaagucccgcuucaccaucucccgcgacaacgccaagaacaccgucuuccuccagaugcacucccuccgcuccgaggacaccgccgucuacuacugcgcccgcgacggcggcuacuccuccuccacccucuacgccauggacgccuggggccagggcaccuccgucaccgucuccuccgccuccaccaccgcccccuccgucuucccccucgcccccuccugcggcuccaccuccggcuccaccgucgcccucgccugccucgucuccggcuacuuccccgagcccgucaccgucuccuggaacuccggcucccucaccuccggcguccacaccuuccccuccguccuccaguccuccggccuccacucccucuccuccauggucaccguccccuccucccgcuggcccuccgagaccuucaccugcaacgucguccaccccgccuccaacaccaaggucgacaagcccgucuucaacgagugccgcugcaccgacaccccccccugccccguccccgagccccucggcggccccuccguccucaucuucccccccaagcccaaggacauccuccgcaucacccgcacccccgaggucaccugcgucguccucgaccucggccgcgaggaccccgagguccagaucuccugguucgucgacggcaaggagguccucaccgccaagacccagucccgcgagcagcaguucaacggcaccuaccaggucgucuccguccuccccaucgagcaccaggacuggcucaccggcaaggaguucaagugccgcgucaaccacaucgaccuccccucccccaucgagcgcaccaucuccaaggcccgcggccgcgcccacaagcccuccgucuacguccucccccccucccccaaggagcucuccuccuccgacaccgucuccaucaccugccucaucaaggacuucuacccccccgacaucgacgucgaguggcaguccgucggccagcaggagcccgagcgcaagcaccgcaugacccccccccagcucgacgaggacggcuccuacuuccucuacuccaagcucuccgucgacaagucccgcuggcagcagggcgaccccuucaccugcgccgucaugcacgagacccuccagaaccacuacaccgaccucucccucucccacucccccggcaag

SEQ ID NO: 16336 - RNA, 651 nt, Artificial Sequence
  derived and/or modified sequence opt2 from Ranevetmab_LightChain
gacaucgucaugacccagucccccgccucccucucccucucccagggcgagaccgucaccaucaccugccgcgccuccgaggacaucuacaacgcccucgccugguaccagcagaagcccggccaggcccccaagcuccucaucuacaacaccgacacccuccacaccggcguccccucccgcuucuccggcuccggcuccggcaccgacuucucccucaccaucuccucccucgagcccgaggacgucgccgucuacuacugccagcacuacuuccacuacccccgcaccuucggccagggcaccaaggucgagcucaagcgcaacgacgcccagcccgccgucuaccucuuccagcccucccccgaccagcuccacaccggcuccgccuccgucgucugccuccucaacuccuucuaccccaaggacaucaacgucaaguggaaggucgacggcgucauccaggacaccggcauccaggaguccgucaccgagcaggacaaggacuccaccuacucccucuccuccacccucaccauguccuccaccgaguaccucucccacgagcucuacuccugcgagaucacccacaagucccuccccuccacccucaucaaguccuuccagcgcuccgagugccagcgcgucgac

SEQ ID NO: 16337 - RNA, 1761 nt, Artificial Sequence
  derived and/or modified sequence opt2 from Remtolumab_HeavyChain
gagguccagcucgucgaguccggcggcggccucguccagcccggccgcucccuccgccucuccugcgccgccuccggcuucaccuucgacgacuacgccaugcacuggguccgccaggcccccggcaagggccucgagugggucuccgccaucaccuggaacuccggccacaucgacuacgccgacuccgucgagggccgcuucaccaucucccgcgacaacgccaagaacucccucuaccuccagaugaacucccuccgcgccgaggacaccgccgucuacuacugcgccaaggucuccuaccucuccaccgccuccucccucgacuacuggggccagggcacccucgucaccgucuccuccggcggcggcggcuccggcggcggcggcuccgagguccagcucguccaguccggcgccgaggucaagaagcccggcuccuccgucaaggucuccugcaaggccuccggcggcuccuucggcggcuacggcaucggcuggguccgccaggcccccggccagggccucgaguggaugggcggcaucacccccuucuucggcuucgccgacuacgcccagaaguuccagggccgcgucaccaucaccgccgacgaguccaccaccaccgccuacauggagcucuccggccucaccuccgacgacaccgccgucuacuacugcgcccgcgaccccaacgaguucuggaacggcuacuacuccacccacgacuucgacuccuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16338 - RNA, 993 nt, Artificial Sequence
  derived and/or modified sequence opt2 from Remtolumab_LightChain
gacauccagaugacccagucccccuccucccucuccgccuccgucggcgaccgcgucaccaucaccugccgcgccucccagggcauccgcaacuaccucgccugguaccagcagaagcccggcaaggcccccaagcuccucaucuacgccgccuccacccuccaguccggcguccccucccgcuucuccggcuccggcuccggcaccgacuucacccucaccaucuccucccuccagcccgaggacgucgccaccuacuacugccagcgcuacaaccgcgcccccuacaccuucggccagggcaccaaggucgagaucaagcgcggcggcuccggcggcggcggcuccggcgagaucguccucacccagucccccgacuuccaguccgucacccccaaggagaaggucaccaucaccugccgcgccucccaggacaucggcuccgagcuccacugguaccagcagaagcccgaccagccccccaagcuccucaucaaguacgccucccacuccaccuccggcguccccucccgcuucuccggcuccggcuccggcaccgacuucacccucaccaucaacggccucgaggccgaggacgccggcaccuacuacugccaccagaccgacucccuccccuacaccuucggccccggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16339 - RNA, 1341 nt, Artificial Sequence
  derived and/or modified sequence opt2 from Rosmantuzumab_HeavyChain
cagguccagcucguccaguccggcgccgaggucaagaagcccggcgccuccgucaaggucuccugcaaggccuccggcuacaccuucaccgacuacuccauccacuggguccgccaggcccccggccagggccucgaguggaucggcuacaucuaccccuccaacggcgacuccggcuacaaccagaaguucaagaaccgcgucaccaugacccgcgacaccuccaccuccaccgccuacauggagcucucccgccuccgcuccgaggacaccgccgucuacuacugcgccaccuacuucgccaacaacuucgacuacuggggccagggcaccacccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16340 - RNA, 654 nt, Artificial Sequence
  derived and/or modified sequence opt2 from Rosmantuzumab_LightChain
gacauccagaugacccagucccccuccucccucuccgccuccgucggcgaccgcgucaccaucaccugcaaggccucccaguccgucgacuacgacggcgacuccuacaugaacugguaccagcagaagcccggcaaggcccccaagcuccucaucuacgccgccuccaaccucgaguccggcguccccucccgcuucuccggcuccggcuccggcaccgacuucacccucaccaucucccccguccaggccgaggacuucgccaccuacuacugccagcaguccaacgaggacccccucaccuucggcgccggcaccaagcucgagcucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16341 - RNA, 1332 nt, Artificial Sequence
  derived and/or modified sequence opt2 from Rozanolixizumab_HeavyChain
gaggucccccucgucgaguccggcggcggccucguccagcccggcggcucccuccgccucuccugcgccgucuccggcuucaccuucuccaacuacggcauggucuggguccgccaggcccccggcaagggccucgagugggucgccuacaucgacuccgacggcgacaacaccuacuaccgcgacuccgucaagggccgcuucaccaucucccgcgacaacgccaaguccucccucuaccuccagaugaacucccuccgcgccgaggacaccgccgucuacuacugcaccaccggcaucguccgccccuuccucuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcaccaagaccuacaccugcaacgucgaccacaagcccuccaacaccaaggucgacaagcgcgucgaguccaaguacggcccccccugcccccccugccccgcccccgaguuccucggcggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuaccgcgucgucuccguccucaccguccuccaccaggacuggcucaacggcaaggaguacaagugcaaggucuccaacaagggccuccccuccuccaucgagaagaccaucuccaaggccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacucccgccucaccgucgacaagucccgcuggcaggagggcaacgucuucuccugcuccgucaugcacgaggcccuccacaaccacuacacccagaagucccucucccucucccucggcaag

SEQ ID NO: 16342 - RNA, 657 nt, Artificial Sequence
  derived and/or modified sequence opt2 from Rozanolixizumab_LightChain
gacauccagaugacccagucccccuccucccucuccgccuccgucggcgaccgcgucaccaucaccugcaaguccucccagucccucgucggcgccuccggcaagaccuaccucuacuggcucuuccagaagcccggcaaggcccccaagcgccucaucuaccucgucuccacccucgacuccggcauccccucccgcuucuccggcuccggcuccggcaccgaguucacccucaccaucuccucccuccagcccgaggacuucgccaccuacuacugccuccagggcacccacuucccccacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16343 - RNA, 1329 nt, Artificial Sequence
  derived and/or modified sequence opt2 from Sapelizumab_HeavyChain
cagguccagcuccaggaguccggccccggccucgucaagcccuccgagacccucucccucaccugcgccgucuccggccacuccaucucccacgaccacgccugguccuggguccgccagccccccggcgagggccucgaguggaucggcuucaucuccuacuccggcaucaccaacuacaaccccucccuccagggccgcgucaccaucucccgcgacaacuccaagaacacccucuaccuccagaugaacucccuccgcgccgaggacaccgccgucuacuacugcgcccgcucccucgcccgcaccaccgccauggacuacuggggcgagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaaguccugcgucgagugcccccccugccccgccccccccgucgccggccccuccgucuuccucuucccccccaagcccaaggacacccucaugaucucccgcacccccgaggucaccugcgucgucgucgacgucucccaggaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccaggaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcaggagggcaacgucuucuccugcuccgucaugcacgaggcccuccacgcccacuacacccagaagucccucucccucuccccc

SEQ ID NO: 16344 - RNA, 642 nt, Artificial Sequence
  derived and/or modified sequence opt2 from Sapelizumab_LightChain
gacauccagaugacccagucccccuccucccucuccgccuccgucggcgacuccgucaccaucaccugccaggccuccaccgacaucuccucccaccucaacugguaccagcagaagcccggcaaggcccccgagcuccucaucuacuacggcucccaccuccucuccggcguccccucccgcuucuccggcuccggcuccggcaccgacuucaccuucaccaucuccucccucgaggccgaggacgccgccaccuacuacugcggccagggcaaccgccuccccuacaccuucggccagggcaccaaggucgagaucgagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16345 - RNA, 1356 nt, Artificial Sequence
  derived and/or modified sequence opt2 from Selicrelumab_HeavyChain
cagguccagcucguccaguccggcgccgaggucaagaagcccggcgccuccgucaaggucuccugcaaggccuccggcuacaccuucaccggcuacuacaugcacuggguccgccaggcccccggccagggccucgaguggaugggcuggaucaaccccgacuccggcggcaccaacuacgcccagaaguuccagggccgcgucaccaugacccgcgacaccuccaucuccaccgccuacauggagcucaaccgccuccgcuccgacgacaccgccgucuacuacugcgcccgcgaccagccccucggcuacugcaccaacggcgucugcuccuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16346 - RNA, 642 nt, Artificial Sequence
  derived and/or modified sequence opt2 from Selicrelumab_LightChain
gacauccagaugacccagucccccuccuccgucuccgccuccgucggcgaccgcgucaccaucaccugccgcgccucccagggcaucuacuccuggcucgccugguaccagcagaagcccggcaaggcccccaaccuccucaucuacaccgccuccacccuccaguccggcguccccucccgcuucuccggcuccggcuccggcaccgacuucacccucaccaucuccucccuccagcccgaggacuucgccaccuacuacugccagcaggccaacaucuucccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16347 - RNA, 354 nt, Artificial Sequence
  derived and/or modified sequence opt2 from Solitomab_HeavyChain1
gagguccagcuccucgagcaguccggcgccgagcucguccgccccggcaccuccgucaagaucuccugcaaggccuccggcuacgccuucaccaacuacuggcucggcugggucaagcagcgccccggccacggccucgaguggaucggcgacaucuuccccggcuccggcaacauccacuacaacgagaaguucaagggcaaggccacccucaccgccgacaaguccuccuccaccgccuacaugcagcucuccucccucaccuucgaggacuccgccgucuacuucugcgcccgccuccgcaacugggacgagcccauggacuacuggggccagggcaccaccgucaccguc

SEQ ID NO: 16348 - RNA, 375 nt, Artificial Sequence
  derived and/or modified sequence opt2 from Solitomab_HeavyChain2
gacguccagcucguccaguccggcgccgaggucaagaagcccggcgccuccgucaaggucuccugcaaggccuccggcuacaccuucacccgcuacaccaugcacuggguccgccaggcccccggccagggccucgaguggaucggcuacaucaaccccucccgcggcuacaccaacuacgccgacuccgucaagggccgcuucaccaucaccaccgacaaguccaccuccaccgccuacauggagcucuccucccuccgcuccgaggacaccgccaccuacuacugcgcccgcuacuacgacgaccacuacugccucgacuacuggggccagggcaccaccgucaccgucuccuccggcgagggcaccuccacc

SEQ ID NO: 16349 - RNA, 1488 nt, Artificial Sequence
  derived and/or modified sequence opt2 from Solitomab_LightChain_HeavyChain_HeavyChain_LightChain
gagcucgucaugacccagucccccuccucccucaccgucaccgccggcgagaaggucaccauguccugcaaguccucccagucccuccucaacuccggcaaccagaagaacuaccucaccugguaccagcagaagcccggccagccccccaagcuccucaucuacugggccuccacccgcgaguccggcguccccgaccgcuucaccggcuccggcuccggcaccgacuucacccucaccaucuccuccguccaggccgaggaccucgccgucuacuacugccagaacgacuacuccuacccccucaccuucggcgccggcaccaagcucgagaucaagggcggcggcggcuccggcggcggcggcuccggcggcggcggcuccgagguccagcuccucgagcaguccggcgccgagcucguccgccccggcaccuccgucaagaucuccugcaaggccuccggcuacgccuucaccaacuacuggcucggcugggucaagcagcgccccggccacggccucgaguggaucggcgacaucuuccccggcuccggcaacauccacuacaacgagaaguucaagggcaaggccacccucaccgccgacaaguccuccuccaccgccuacaugcagcucuccucccucaccuucgaggacuccgccgucuacuucugcgcccgccuccgcaacugggacgagcccauggacuacuggggccagggcaccaccgucaccgucuccuccggcggcggcggcuccgacguccagcucguccaguccggcgccgaggucaagaagcccggcgccuccgucaaggucuccugcaaggccuccggcuacaccuucacccgcuacaccaugcacuggguccgccaggcccccggccagggccucgaguggaucggcuacaucaaccccucccgcggcuacaccaacuacgccgacuccgucaagggccgcuucaccaucaccaccgacaaguccaccuccaccgccuacauggagcucuccucccuccgcuccgaggacaccgccaccuacuacugcgcccgcuacuacgacgaccacuacugccucgacuacuggggccagggcaccaccgucaccgucuccuccggcgagggcaccuccaccggcuccggcggcuccggcggcuccggcggcgccgacgacaucguccucacccagucccccgccacccucucccucucccccggcgagcgcgccacccucuccugccgcgccucccaguccgucuccuacaugaacugguaccagcagaagcccggcaaggcccccaagcgcuggaucuacgacaccuccaaggucgccuccggcguccccgcccgcuucuccggcuccggcuccggcaccgacuacucccucaccaucaacucccucgaggccgaggacgccgccaccuacuacugccagcagugguccuccaacccccucaccuucggcggcggcaccaaggucgagaucaag

SEQ ID NO: 16350 - RNA, 339 nt, Artificial Sequence
  derived and/or modified sequence opt2 from Solitomab_LightChain1
gagcucgucaugacccagucccccuccucccucaccgucaccgccggcgagaaggucaccauguccugcaaguccucccagucccuccucaacuccggcaaccagaagaacuaccucaccugguaccagcagaagcccggccagccccccaagcuccucaucuacugggccuccacccgcgaguccggcguccccgaccgcuucaccggcuccggcuccggcaccgacuucacccucaccaucuccuccguccaggccgaggaccucgccgucuacuacugccagaacgacuacuccuacccccucaccuucggcgccggcaccaagcucgagaucaag

SEQ ID NO: 16351 - RNA, 324 nt, Artificial Sequence
  derived and/or modified sequence opt2 from Solitomab_LightChain2
gccgacgacaucguccucacccagucccccgccacccucucccucucccccggcgagcgcgccacccucuccugccgcgccucccaguccgucuccuacaugaacugguaccagcagaagcccggcaaggcccccaagcgcuggaucuacgacaccuccaaggucgccuccggcguccccgcccgcuucuccggcuccggcuccggcaccgacuacucccucaccaucaacucccucgaggccgaggacgccgccaccuacuacugccagcagugguccuccaacccccucaccuucggcggcggcaccaaggucgagaucaag

SEQ ID NO: 16352 - RNA, 1359 nt, Artificial Sequence
  derived and/or modified sequence opt2 from Suptavumab_HeavyChain2
gagguccagcucgucgaguccggcggcgaccucguccagcccggccgcucccuccgccucuccugcgucgccuccggcuucaccuucgacgacuacgccaugcacuggguccgccaggcccccggcaagggccucgagugggucuccggcgucuccugguccggcuccaccgucggcuacgccgacuccgucaagggccgcuucaccgucucccgcgacaacgcccagaagucccucuaccuccagaugaacucccuccgcgccgaggacaccgcccucuacuacugcgucaaggacgccuacaaguucaacuacuacuacuacggccucgacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16353 - RNA, 1356 nt, Artificial Sequence
  derived and/or modified sequence opt2 from Suvratoxumab_HeavyChain
gagguccagcucgucgaguccggcggcggccucguccagcccggcggcucccuccgccucuccugcgccgccuccggcuucaccuucuccucccacgacaugcacuggguccgccaggccaccggcaagggccucgagugggucuccggcaucggcaccgccggcgacaccuacuaccccgacuccgucaagggccgcuucaccaucucccgcgagaacgccaagaacucccucuaccuccagaugaacucccuccgcgccggcgacaccgccgucuacuacugcgcccgcgaccgcuacucccccaccggccacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucuacaucacccgcgagcccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16354 - RNA, 639 nt, Artificial Sequence
  derived and/or modified sequence opt2 from Suvratoxumab_LightChain
gacauccagaugacccagucccccuccacccucuccgccuccgucggcgaccgcgucaccaucaccugccgcgccucccaguccaucuccuccuggcucgccugguaccagcagaagcccggcaaggcccccaagcuccucaucuacaaggccuccucccucgaguccggcguccccucccgcuucuccggcuccggcuccggcaccgaguucacccucaccaucuccucccuccagcccgacgacuucgccaccuacuacugcaagcaguacgccgacuacuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16355 - RNA, 642 nt, Artificial Sequence
  derived and/or modified sequence opt2 from Tadocizumab_LightChain
gacauccagaugacccagacccccuccacccucuccgccuccgucggcgaccgcgucaccaucuccugccgcgccucccaggacaucaacaacuaccucaacugguaccagcagaagcccggcaaggcccccaagcuccucaucuacuacaccuccacccuccacuccggcguccccucccgcuucuccggcuccggcuccggcaccgacuacacccucaccaucuccucccuccagcccgacgacuucgccaccuacuucugccagcagggcaacacccuccccuggaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16356 - RNA, 1341 nt, Artificial Sequence
  derived and/or modified sequence opt2 from Tanezumab_HeavyChain
cagguccagcuccaggaguccggccccggccucgucaagcccuccgagacccucucccucaccugcaccgucuccggcuucucccucaucggcuacgaccucaacuggauccgccagccccccggcaagggccucgaguggaucggcaucaucuggggcgacggcaccaccgacuacaacuccgccgucaagucccgcgucaccaucuccaaggacaccuccaagaaccaguucucccucaagcucuccuccgucaccgccgccgacaccgccgucuacuacugcgcccgcggcggcuacugguacgccaccuccuacuacuucgacuacuggggccagggcacccucgucaccgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgagcgcaagugcugcgucgagugcccccccugccccgccccccccgucgccggccccuccgucuuccucuucccccccaagcccaaggacacccucaugaucucccgcacccccgaggucaccugcgucgucgucgacgucucccacgaggaccccgagguccaguucaacugguacgucgacggcgucgagguccacaacgccaagaccaagccccgcgaggagcaguucaacuccaccuuccgcgucgucuccguccucaccgucguccaccaggacuggcucaacggcaaggaguacaagugcaaggucuccaacaagggccuccccuccuccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccaugcucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16357 - RNA, 642 nt, Artificial Sequence
  derived and/or modified sequence opt2 from Tanezumab_LightChain
gacauccagaugacccagucccccuccucccucuccgccuccgucggcgaccgcgucaccaucaccugccgcgccucccaguccaucuccaacaaccucaacugguaccagcagaagcccggcaaggcccccaagcuccucaucuacuacaccucccgcuuccacuccggcguccccucccgcuucuccggcuccggcuccggcaccgacuucaccuucaccaucuccucccuccagcccgaggacaucgccaccuacuacugccagcaggagcacacccuccccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16358 - RNA, 1353 nt, Artificial Sequence
  derived and/or modified sequence opt2 from Tavolixizumab_HeavyChain
cagguccagcuccaggaguccggccccggccucgucaagcccucccagacccucucccucaccugcgccgucuacggcggcuccuucuccuccggcuacuggaacuggauccgcaagcaccccggcaagggccucgaguacaucggcuacaucuccuacaacggcaucaccuaccacaaccccucccucaagucccgcaucaccaucaaccgcgacaccuccaagaaccaguacucccuccagcucaacuccgucacccccgaggacaccgccgucuacuacugcgcccgcuacaaguacgacuacgacggcggccacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccaggaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16359 - RNA, 642 nt, Artificial Sequence
  derived and/or modified sequence opt2 from Tavolixizumab_LightChain
gacauccagaugacccagucccccuccucccucuccgccuccgucggcgaccgcgucaccaucaccugccgcgccucccaggacaucuccaacuaccucaacugguaccagcagaagcccggcaaggcccccaagcuccucaucuacuacaccuccaagcuccacuccggcguccccucccgcuucuccggcuccggcuccggcaccgacuacacccucaccaucuccucccuccagcccgaggacuucgccaccuacuacugccagcagggcuccgcccuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16360 - RNA, 1335 nt, Artificial Sequence
  derived and/or modified sequence opt2 from Telisotuzumab_HeavyChain
cagguccagcucguccaguccggcgccgaggucaagaagcccggcgccuccgucaaggucuccugcaaggccuccggcuacaucuucaccgccuacaccaugcacuggguccgccaggcccccggccagggccucgaguggaugggcuggaucaagcccaacaacggccucgccaacuacgcccagaaguuccagggccgcgucaccaugacccgcgacaccuccaucuccaccgccuacauggagcucucccgccuccgcuccgacgacaccgccgucuacuacugcgcccgcuccgagaucaccaccgaguucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacugccacugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggc

SEQ ID NO: 16361 - RNA, 654 nt, Artificial Sequence
  derived and/or modified sequence opt2 from Telisotuzumab_LightChain
gacaucgucaugacccagucccccgacucccucgccgucucccucggcgagcgcgccaccaucaacugcaaguccuccgaguccgucgacuccuacgccaacuccuuccuccacugguaccagcagaagcccggccagccccccaagcuccucaucuaccgcgccuccacccgcgaguccggcguccccgaccgcuucuccggcuccggcuccggcaccgacuucacccucaccaucuccucccuccaggccgaggacgucgccgucuacuacugccagcaguccaaggaggacccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16362 - RNA, 1335 nt, Artificial Sequence; identical to SEQ ID NO: 16360
  derived and/or modified sequence opt2 from Telisotuzumab_vedotin_HeavyChain

SEQ ID NO: 16363 - RNA, 654 nt, Artificial Sequence; identical to SEQ ID NO: 16361
  derived and/or modified sequence opt2 from Telisotuzumab_vedotin_LightChain

SEQ ID NO: 16364 - RNA, 1350 nt, Artificial Sequence
  derived and/or modified sequence opt2 from Timigutuzumab_HeavyChain
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 16365 - RNA, 642 nt, Artificial Sequence; identical to SEQ ID NO: 16026
  derived and/or modified sequence opt2 from Timigutuzumab_LightChain

SEQ ID NO: 16366 - RNA, 1332 nt, Artificial Sequence; identical to SEQ ID NO: 15410
  derived and/or modified sequence opt2 from Timolumab_HeavyChain

SEQ ID NO: 16367 - RNA, 642 nt, Artificial Sequence; identical to SEQ ID NO: 15411
  derived and/or modified sequence opt2 from Timolumab_LightChain

SEQ ID NO: 16368 - RNA, 1347 nt, Artificial Sequence
  derived and/or modified sequence opt2 from Tomuzotuximab_HeavyChain
cagguccagcucaagcaguccggccccggccucguccagcccucccagucccucuccaucaccugcaccgucuccggcuucucccucaccaacuacggcguccacuggguccgccagucccccggcaagggccucgaguggcucggcgucaucugguccggcggcaacaccgacuacaacacccccuucaccucccgccucuccaucaacaaggacaacuccaagucccaggucuucuucaagaugaacucccuccaguccaacgacaccgccaucuacuacugcgcccgcgcccucaccuacuacgacuacgaguucgccuacuggggccagggcacccucgucaccgucuccaccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgagggccuccacaaccacuacacccagaagucccucucccucucccccggcaag

SEQ ID NO: 16369 - RNA, 642 nt, Artificial Sequence; identical to SEQ ID NO: 15441
  derived and/or modified sequence opt2 from Tomuzotuximab_LightChain

SEQ ID NO: 16370 - RNA, 1347 nt, Artificial Sequence; identical to SEQ ID NO: 16169
  derived and/or modified sequence opt2 from Trastuzumab_duocarmazine_HeavyChain

SEQ ID NO: 16371 - RNA, 642 nt, Artificial Sequence; identical to SEQ ID NO: 16026
  derived and/or modified sequence opt2 from Trastuzumab_duocarmazine_LightChain

SEQ ID NO: 16372 - RNA, 1368 nt, Artificial Sequence
  derived and/or modified sequence opt2 from Varisacumab_HeavyChain
cagguccagcucguccaguccggcgccgaggucaagaagcccggcgccuccgucaaggucuccugcaaggccuccggcggcaccuucuccuccuacgccaucuccuggguccgccaggcccccggccagggccucgaguggaugggcggcuucgaccccgaggacggcgagaccaucuacgcccagaaguuccagggccgcgucaccaugaccgaggacaccuccaccgacaccgccuacauggagcucuccucccuccgcuccgaggacaccgccgucuacuacugcgccaccggccgcuccaugguccgcggcgucaucauccccuucaacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16373 - RNA, 642 nt, Artificial Sequence
  derived and/or modified sequence opt2 from Varisacumab_LightChain
gacauccgcaugacccagucccccuccucccucuccgccuccgucggcgaccgcgucaccaucaccugccgcgccucccaguccaucuccuccuaccucaacugguaccagcagaagcccggcaaggcccccaagcuccucaucuacgccgccuccucccuccaguccggcguccccucccgcuucuccggcuccggcuccggcaccgacuucacccucaccaucuccucccuccagcccgaggacuucgccaccuacuacugccagcaguccuacuccaccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16374 - RNA, 1359 nt, Artificial Sequence
  derived and/or modified sequence opt2 from Vunakizumab_HeavyChain
gagguccagcucguccaguccggcgccgaggucaagaagcccggcgccuccgucaaggucuccugcaaggccuccggcuacaccuucaccgacuacgagguccacuggguccgccaggcccccggccagggccucgaguggaugggcgucaucgaccccggcaccggcggcgucgccuacaaccagaaguucgagggccgcgucaccaugaccgccgacaccuccaccuccaccgccuacauggagcuccgcucccuccgcuccgacgacaccgccgucuacuacugcacccgcuacucccucuucuacggcuccucccccuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16375 - RNA, 639 nt, Artificial Sequence
  derived and/or modified sequence opt2 from Vunakizumab_LightChain
gagaucguccucacccagucccccgacuuccaguccgucacccccaaggagaaggucaccaucaccugcuccgccuccuccuccgucaacuacaugcacugguuccagcagaagcccgaccagucccccaagcucuggaucuaccgcaccuccaaccucgccuccggcguccccucccgcuucuccggcuccggcuccggcaccgacuacacccucaccaucaacucccucgaggccgaggacgccgccaccuacuacugccagcagcgcuccuccuaccccuggaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16376 - RNA, 1341 nt, Artificial Sequence; identical to SEQ ID NO: 16279
  derived and/or modified sequence opt2 from Xentuzumab_HeavyChain

SEQ ID NO: 16377 - RNA, 648 nt, Artificial Sequence; identical to SEQ ID NO: 16280
  derived and/or modified sequence opt2 from Xentuzumab_LightChain

SEQ ID NO: 16378 - RNA, 726 nt, Artificial Sequence
  derived and/or modified sequence opt2 from anti-rabies_SO57_LightChain
auguccguccccaccauggccugggcccuccuccuccucucccuccucacccagggcaccggcuccugggcccaguccgcccucacccagccccgcuccgucuccggcucccccggccaguccgucaccaucuccugcaccggcaccuccuccgacaucggcggcuacaacuucgucuccugguaccagcagcaccccggcaaggcccccaagcucaugaucuacgacgccaccaagcgccccuccggcguccccgaccgcuucuccggcuccaaguccggcaacaccgccucccucaccaucuccggccuccaggccgaggacgaggccgacuacuacugcugcuccuacgccggcgacuacacccccggcgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16379 - RNA, 1428 nt, Artificial Sequence
  derived and/or modified sequence opt2 from anti-rabies_SO57_HeavyChain
auggacuggaccuggcgcuuccucuucgucgucgccgccgccaccggcguccagucccagguccagcucguccaguccggcgccgaggucaagaagcccggcuccuccgucaaggucuccugcaaggccuccggcggcaccuucaaccgcuacaccgucaacuggguccgccaggcccccggccagggccucgaguggaugggcggcaucauccccaucuucggcaccgccaacuacgcccagcgcuuccagggccgccucaccaucaccgccgacgaguccaccuccaccgccuacauggagcucuccucccuccgcuccgacgacaccgccgucuacuucugcgcccgcgagaaccucgacaacuccggcaccuacuacuacuucuccggcugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16380 - RNA, 696 nt, Artificial Sequence
  derived and/or modified sequence opt2 from anti-rabies_SOJB_LightChain
auggccuggaccguccuccuccucggccuccucucccacugcaccggcuccgucaccuccuacguccucacccagccccccuccgucuccgucgcccccggcaagaccgcccgcaucaacugcggcggcaacaacaucgaguaccgcuccguccacugguaccagcagaaguccggccaggcccccgucgccgucaucuacgacaacuccgaccgccccuccggcauccccgagcgcuucuccggcuccaaguccggcaacaccgccacccucaccaucucccgcgucgaggccggcgacgaggccgacuacuacugccaggucugggacaucuccuccgacgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16381 - RNA, 1554 nt, Artificial Sequence
  derived and/or modified sequence opt2 from anti-rabies_SOJB_HeavyChain
auggacacccucugcuccacccuccuccuccucaccauccccuccuggguccucucccagaucacccucaaggagaccggccccacccucgucaagcccacccagacccucacccucaccugcaccuucuccggcuucucccucuccaccuccggcgucggcgucggcuggauccgccagccccccggcaaggcccucgagugggucacccucaucuacugggacgacgacaagcgcuacucccccucccucgagaaccgcgucaccauccgcaaggacaccuccaagaaccaggucgcccucaccaugaccaacauggacccccucgacaccggcaccuacuacugcgcccaccgccagcacaucuccuccuuccccugguucgacuccuggggccagggcacccucgucaccgucuccuccgccuccaccaagggccccuccgucuucccccucgcccccugcucccgcuccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucaaccacaagcccuccaacaccaaggucgacaagcgcgucgagcucaagaccccccucggcgacaccacccacaccugcccccgcugccccgagcccaaguccugcgacacccccccccccugcccccgcugccccgagcccaaguccugcgacacccccccccccugcccccgcugccccgagcccaaguccugcgacacccccccccccugcccccgcugccccgcccccgagcuccucggcggccccuccgucuuccucuucccccccaagcccaaggacacccucaugaucucccgcacccccgaggucaccugcgucgucgucgacgucucccacgaggaccccgagguccaguucaagugguacgucgacggcgucgagguccacaacgccaagaccaagccccgcgaggagcaguucaacuccaccuuccgcgucgucuccguccucaccguccuccaccaggacuggcucaacggcaaggaguacaagugcaaggucuccaacaaggcccuccccgcccccaucgagaagaccaucuccaagaccaagggccagccccgcgagccccaggucuacacccucccccccucccgcgaggagaugaccaagaaccaggucucccucaccugccucgucaagggcuucuaccccuccgacaucgccgucgagugggaguccuccggccagcccgagaacaacuacaacaccaccccccccaugcucgacuccgacggcuccuucuuccucuacuccaagcucaccgucgacaagucccgcuggcagcagggcaacaucuucuccugcuccgucaugcacgaggcccuccacaaccgcuucacccagaagucccucucccucucccccggcaag

SEQ ID NO: 16382 - RNA, 702 nt, Artificial Sequence
  derived and/or modified sequence opt2 from anti-rabies_SOJA_LightChain
auggaggcccccgcccagcuccucuuccuccuccuccucuggcuccccgacaccaccggcgagaucguccucacccagucccccgccacccucucccucucccccggcgagcgcgccacccucgccugccgcgccucccagaccgccucccgcuaccucgccugguaccagcagaagcccggccaggccccccgccuccucaucuacgacaccuccaaccgcgccaccggcauccccgcccgcuucuccggcuccggcuccggcaccgacuucacccucuccaucuccucccucgagcccgaggacuucgccgucuacuacugccagcagcgcuucaacuggcccuggaccuucggccagggcaccaaggucgaguucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16383 - RNA, 1422 nt, Artificial Sequence
  derived and/or modified sequence opt2 from anti-rabies_SOJA_HeavyChain
auggaguucggccucuccuggcucuuccucgucgccauccucaagggcguccagugcgagguccagcuccucgaguccggcggcggccucguccagcccggcggcucccuccgccucuccugcgccgccuccggcuucaccuucuccaacuacgccauguccuggguccgccaggcccccggcaagggccucgagugggucuccgccaucuccgccuccggccacuccaccuaccucgccgacuccgucaagggccgcuucaccaucucccgcgacaacuccaagaacacccucuaccuccagaugaacucccuccgcgccgaggacaccgccgucuacuacugcgccaaggaccgcgaggucaccaugaucgucguccucaacggcggcuucgacuacuggggccagggcacccgcgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 16384 - RNA, 321 nt, Artificial Sequence
  derived and/or modified sequence opt2 from anti-rabies_LightChain
gucaugacccagucccccgccacccucucccucucccccggcgagcgcgccacccucuccugccgcgccucccaguccguccgcaacuaccucgccugguaccagcagaagcccggccaggccccccgccuccucaucuacggcgccuccaaccgcgccaccggcauccccgcccgcuucuccggcuccggcuccggcaccgacuucacccucaccaucuccucccucgagcccgaggacuucgccgucuacuacugccagcagcgcuccgacuggccccucuccuucggccagggcaccaagcucgagaucaagcgcacc

SEQ ID NO: 16385 - RNA, 333 nt, Artificial Sequence
  derived and/or modified sequence opt2 from anti-rabies_HeavyChain
ggccccgccugggagguccccgagacccuccccguccagccccucgacucccccuccgucgccauggccugcaccggcguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggacuccaacuccggcuccuacuacgcccacgaccucggcuacuggggccagggcacccucgucaccguc

SEQ ID NO: 16386 - RNA, 342 nt, Artificial Sequence
  derived and/or modified sequence opt2 from anti-rabies_LightChain
gagcucgucaugacccaguccccccucucccuccccgucacccucggccagcccgccuccaucuccugccgcuccucccagucccucauccacuccaacggcaacaccuaccucaacugguuccagcagcgccccggccaguccccccgccgccucaucuacaaggucuccgaccgcgacuccggcguccccgaccgcuucuccggcuccggcuccggcaccgacuucacccucaagaucucccgcgucgaggccgaggacgucggcgucuacuacugccuccagggcacccacuggccccgcaccuucggccagggcaccaagcucgagaucaagcgcacc

SEQ ID NO: 16387 - RNA, 351 nt, Artificial Sequence
  derived and/or modified sequence opt2 from anti-rabies_HeavyChain
gucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcgacaaggcccucgccgcccgccgcggcuacuacuacuacuacggcaccgacgucuggggccagggcacccucgucaccgucuccucc

SEQ ID NO: 16388 - RNA, 648 nt, Artificial Sequence
  derived and/or modified sequence opt2 from anti-RSV_5ITB_LightChain
uccgacauccagaugacccagucccccuccacccucuccgccuccgucggcgaccgcgucaccaucaccugccgcgccucccaguccaucuccuccuggcucgccugguaccagcagaagcccggcaaggcccccaagcuccucaucuacgacgccuccucccucgaguccggcguccccucccgcuucuccggcuccggcuccggcaccgaguucacccucaccaucuccucccuccagcccgacgacuucgccaccuacuacugccagcaguacaacaccuacuccugguggaccuucggccagggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16389 - RNA, 660 nt, Artificial Sequence
  derived and/or modified sequence opt2 from anti-RSV_5ITB_HeavyChain
gucgaguccggcggcggccucauccagcccggcggcucccuccgccucuccugcgccgucuccggcuucaccgucuccuccaaguacaugaccuggguccgccaggcccccggcaagggccucgagugggucuccgucaucuacggcggcggcuccaccuacuacgccgacuccgucgucggccgcuucaccaucucccgcgacaacuccaagaacacccucuaccuccagaugaacucccuccgcgccgaggacaccgccgucuacuacugcgccucccgccucggcguccgcgccaccaccggcgaccucgacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugc

SEQ ID NO: 16390 - RNA, 639 nt, Artificial Sequence; identical to SEQ ID NO: 16354
  derived and/or modified sequence opt2 from anti-alpha-toxin_4U6V_LightChain

SEQ ID NO: 16391 - RNA, 675 nt, Artificial Sequence
  derived and/or modified sequence opt2 from anti-alpha-toxin_4U6V_HeavyChain
gagguccagcucgucgaguccggcggcggccucguccagcccggcggcucccuccgccucuccugcgccgccuccggcuucaccuucuccucccacgacaugcacuggguccgccaggccaccggcaagggccucgagugggucuccggcaucggcaccgccggcgacaccuacuaccccgacuccgucaagggccgcuucaccaucucccgcgagaacgccaagaacucccucuaccuccagaugaacucccuccgcgccggcgacaccgccgucuacuacugcgcccgcgaccgcuacucccccaccggccacuacuacggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugc

SEQ ID NO: 16392 - RNA, 879 nt, Artificial Sequence
  derived and/or modified sequence opt2 from anti-alpha-toxin_4U6V_Chain-A
gccgacuccgacaucaacaucaagaccggcaccaccgacaucggcuccaacaccaccgucaagaccggcgaccucgucaccuacgacaaggagaacggcaugcacaagaaggucuucuacuccuucaucgacgacaagaaccacaacaagaagcuccucgucauccgcaccaagggcaccaucgccggccaguaccgcgucuacuccgaggagggcgccaacaaguccggccucgccuggcccuccgccuucaagguccagcuccagcuccccgacaacgaggucgcccagaucuccgacuacuacccccgcaacuccaucgacaccaaggaguacauguccacccucaccuacggcuucaacggcaacgucaccggcgacgacaccggcaagaucggcggccucaucggcgccaacgucuccaucggccacacccucaaguacguccagcccgacuucaagaccauccucgagucccccaccgacaagaaggucggcuggaaggucaucuucaacaacauggucaaccagaacuggggccccuacgaccgcgacuccuggaaccccgucuacggcaaccagcucuucaugaagacccgcaacggcuccaugaaggccgccgacaacuuccucgaccccaacaaggccuccucccuccucuccuccggcuucucccccgacuucgccaccgucaucaccauggaccgcaaggccuccaagcagcagaccaacaucgacgucaucuacgagcgcguccgcgacgacuaccagcuccacuggaccuccaccaacuggaagggcaccaacaccaaggacaaguggaucgaccgcuccuccgagcgcuacaagaucgacugggagaaggaggagaugaccaac

SEQ ID NO: 16393 - RNA, 879 nt, Artificial Sequence; identical to SEQ ID NO: 16392
  derived and/or modified sequence opt2 from anti-alpha-toxin_4U6V_Chain-B

SEQ ID NO: 16394 - RNA, 642 nt, Artificial Sequence
  derived and/or modified sequence opt2 from anti-IsdB_5D1Q_Chain-A
gacauccagcucacccagucccccuccuccgucuccgccuccgucggcgaccgcaucaccaucaccugccgcgccucccaggacaucuccaacugggucgccugguaccagcagaagcccggcaaggcccccaagcuccucaucuacuccgccuccucccuccaguccggcguccccucccgcuucuccggcuccggcuccggcaccgacuucacccucaccaucuccucccuccagcccgaggacuucgccaccuacuacugccagcaggccaacaccuuccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16395 - RNA, 783 nt, Artificial Sequence
  derived and/or modified sequence opt2 from anti-IsdB_5D1Q_Chain-B
cagguccagcucguccaguccggcgccgaggucaagaagcccgccuccuccgucaaggucuccugccaggccuccggcggcuccuucuccacccgcaccaucuccuggcuccgccaggcccccggccagggccucgaguggaugggcggcaucucccccaucuucggcgccgccaacuacgcccagcgcuuccagggccgcgucaccaucaccgccgacaaguccaccuccaccgccuacauggagcucaccucccucaccuccgaggacaccgccgucuacuacugcgcccgcgaccgcccccccggcgcccaguucgacaccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcggcggcggcuccggccaccaccaccaccaccaccaccaccaccacggcggcgacuacaaggaccacgacggcgacuacaaggaccacgacaucgacuacaaggacgacgacgacaag

SEQ ID NO: 16396 - RNA, 822 nt, Artificial Sequence
  derived and/or modified sequence opt2 from anti-IsdB_5D1Q_Chain-C
gagguccagcucgucgaguccggcggcggccucguccagcccggcggcucccucacccucuccugcgccgccuccggccucaucuucuccgacuccaccaugcacuggguccgccaggccuccggccgcggccucgagugggucgcccgcauccgcuccaaggccaacaacuacgccaccuccuccgacaaguccgccaccgccuaccucgccuccgucaagggccgcuucaccaucucccgcgacgacuccaaggacaccaccuuccucgagauguccucccucaagaucgaggacaccgccgucuacuacugcaucgccuccuccaccaccggcugguacguccgcgaggacuucgacuacuggggccacggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcggcggcggcuccggccaccaccaccaccaccaccaccaccaccacggcggcgacuacaaggaccacgacggcgacuacaaggaccacgacaucgacuacaaggacgacgacgacaag

SEQ ID NO: 16397 - RNA, 648 nt, Artificial Sequence
  derived and/or modified sequence opt2 from anti-IsdB_5D1Q_Chain-D
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucuccaucucccgccucgagcccgaggacuucgccgucuacuacugccuccacuacggcaccucccccauguacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16398 - RNA, 360 nt, Artificial Sequence
  derived and/or modified sequence opt2 from anti-IsdB_5D1Q_Chain-E
cccggcaagaugaccgaccuccaggacaccaaguacgucgucuacgaguccgucgagaacaacgaguccaugauggacaccuucgucaagcaccccaucaagaccggcaugcucaacggcaagaaguacauggucauggagaccaccaacgacgacuacuggaaggacuucauggucgagggccagcgcguccgcaccaucuccaaggacgccaagaacaacacccgcaccaucaucuuccccuacgucgagggcaagacccucuacgacgccaucgucaagguccacgucaagaccaucgacuacgacggccaguaccacguccgcaucgucgacaaggaggccuucaccaaggccaac

SEQ ID NO: 16399 - RNA, 657 nt, Artificial Sequence
  derived and/or modified sequence opt2 from anti-IsdB_5D1X_Chain-A
gacaucgucaugacccaguccccccucucccuccccgucacccucggccagcccgccuccaucuccugcuccuccgcccagucccucguccacuccgacggcgacuccuaccucaccugguuccaccagcgccccggccaguccccccgccgccucaucuacaaggucuccauccgcgacgccggcguccccgaccgcuucuccggcuccggcuccggcaccgacuucacccucaagaucucccgcgucgaggccgaggacgucggcgucuacuacugcaugcaggccacccacuggcccuacaccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16400 - RNA, 777 nt, Artificial Sequence
  derived and/or modified sequence opt2 from anti-IsdB_5D1X_Chain-B
cagguccagcucguccaguccggcuccgaggucaagaagcccggcuccuccgucacccucuccugcaaggccuccggcgacaccuucaacacccacaccuacuccuggguccgccaggcccccggccagcgccucgaguggaucggcggcaucaugcccaucuucgccgccuccaaguccgccccccaccuccaggaccgccucaccaucaccgccaacaaggccacccgcaccgccuacauggagcucaccucccucaccuccgacgacuccggcgucuacuacugcgcccgcgacggccgcggcgcccuccaguacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcggcggcggcuccggccaccaccaccaccaccaccaccaccaccacggcggcgacuacaaggaccacgacggcgacuacaaggaccacgacaucgacuacaaggacgacgacgacaag

SEQ ID NO: 16401 - RNA, 822 nt, Artificial Sequence; identical to SEQ ID NO: 16396
  derived and/or modified sequence opt2 from anti-IsdB_5D1X_Chain-C

SEQ ID NO: 16402 - RNA, 648 nt, Artificial Sequence
  derived and/or modified sequence opt2 from anti-IsdB_5D1X_Chain-D
gagaucguccucacccagacccccgccacccucucccucacccccggcgagcgcgccacccucaccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucuccaucucccgccucgagcccgaggacuucgccgucuacuacugccuccacuacggcaccucccccauguacuucuucggccgcggcaccguccucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16403 - RNA, 354 nt, Artificial Sequence
  derived and/or modified sequence opt2 from anti-IsdB_5D1X_Chain-E
aagaugaccgaccuccaggacaccaaguacgucgucuacgaguccgucgagaacaacgaguccaugauggacaccuucgucaagcaccccaucaagaccggcaugcucaacggcaagaaguacauggucauggagaccaccaacgacgacuacuggaaggacuucauggucgagggccagcgcguccgcaccaucuccaaggacgccaagaacaacacccgcaccaucaucuuccccuacgucgagggcaagacccucuacgacgccaucgucaagguccacgucaagaccaucgacuacgacggccaguaccacguccgcaucgucgacaaggaggccuucaccaaggccaac

SEQ ID NO: 16404 - RNA, 792 nt, Artificial Sequence
  derived and/or modified sequence opt2 from anti-IsdB_5D1Z_Chain-B
gccgagguccagcucgucgaguccggcggcggcgucguccagcccggcggcucccuccgccucuccugcgccgccuccggcuucaccuucaacaaguucuggaugaacuggguccgccaggcccccggcaagggccucgagugggucgccgacauccaggucgacggcuccgagaagaacuacgucgacuccgucaagggccgcuucaccaucucccgcgacaacggcaagaacucccucuaccuccagaugaacucccuccgcgccgaggacaccggcgucuacuacugcgcccgcggccgcuacgacuacugguccggcuaccucucccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcggcggcggcuccggccaccaccaccaccaccaccaccaccaccacggcggcgacuacaaggaccacgacggcgacuacaaggaccacgacaucgacuacaaggacgacgacgacaag

SEQ ID NO: 16405 - RNA, 642 nt, Artificial Sequence
  derived and/or modified sequence opt2 from anti-IsdB_5D1Z_Chain-C
gacauccagcucacccagucccccuccuuccucuccgccuccgucgccgaccgcgucaccaucaccugccgcgccucccaggccguccgcuccucccucgccugguaccagcagaagcccggcaaggccccccagcuccucaucuacuccgccuccacccucgagaacggcgucuccucccgcuucuccggcuccggccccggcaccgaguucacccucaccaucuccucccuccagcccgaggacgucggcaccuacuacugccagcagcucaacaccuaccccuucaccuucggccccggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16406 - RNA, 810 nt, Artificial Sequence
  derived and/or modified sequence opt2 from anti-IsdB_5D1Z_Chain-D
cagguccagcuccaggaguccggccccggccucgucaagcccuccgagacccucucccucaucugcaccgucuccggcggcuccaucuccuccuccuccuacuacuggggcuggauccgccagacccccgagcgcaaccucgaguggaucggcaucaucuacuucuccggcaccaccuacuacaaccccucccuccagucccgcgucuccaugucccucgaccgcuccaccaaccgcuucucccuccgccucuccuccgucaccgccgccgacaccgccaucuacuacugcgccaagcccaagucccgcgaccgcggcggccccggcgacgacuacuucggcauggacgucuggggccagggcaucauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcggcggcggcuccggccaccaccaccaccaccaccaccaccaccacggcggcgacuacaaggaccacgacggcgacuacaaggaccacgacaucgacuacaaggacgacgacgacaag

SEQ ID NO: 16407 - RNA, 810 nt, Artificial Sequence; identical to SEQ ID NO: 16406
  derived and/or modified sequence opt2 from anti-IsdB_5D1Z_Chain-F

SEQ ID NO: 16408 - RNA, 792 nt, Artificial Sequence; identical to SEQ ID NO: 16404
  derived and/or modified sequence opt2 from anti-IsdB_5D1Z_Chain-G

SEQ ID NO: 16409 - RNA, 642 nt, Artificial Sequence
  derived and/or modified sequence opt2 from anti-IsdB_5D1Z_HeavyChain
gacauccagaugacccagucccccuccuuccucuccgccuccgucggcgaccgcgucaccaucaccugccgcgccucccagggcaucaccaccuaccucggcugguaccagcagcgccccggcaaggccccccagcuccucaucuacgccgccuccucccuccaguccggcguccccccccgcuucuccggcuccggcuccggcaccgaguucacccucaccaucuccucccuccagcccgaggacuucgccaccuacuacugccagcagcucaacaccuaccccuacaccuucggccccggcacccgccucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16410 - RNA, 471 nt, Artificial Sequence
  derived and/or modified sequence opt2 from anti-IsdB_5D1Z_Chain-I
ggccccgccaaggccaccaacaacaccuaccccauccucaaccaggagcuccgcgaggccaucaagaaccccgccaucaaggacaaggaccacuccgcccccaacucccgccccaucgacuucgagaugaagaagaaggacggcacccagcaguucuaccacuacgccuccuccgucaagcccgcccgcgucaucuucaccgacuccaagcccgagaucgagcucggccuccaguccggccaguucuggcgcaaguucgaggucuacgagggcgacaagaagcuccccaucaagcucgucuccuacgacaccgucaaggacuacgccuacauccgcuucuccgucuccaacggcaccaaggccgucaagaucgucuccuccacccacuucaacaacaaggaggagaaguacgacuacacccucauggaguucgcccagcccaucuacaacuccgccgacaaguucaagacc

SEQ ID NO: 16411 - RNA, 324 nt, Artificial Sequence
  derived and/or modified sequence opt2 from anti-HIV_b12_LightChain
gagaucguccucacccagucccccggcacccucucccucucccccggcgagcgcgccaccuucuccugccgcuccucccacuccauccgcucccgccgcgucgccugguaccagcacaagcccggccaggccccccgccucgucauccacggcgucuccaaccgcgccuccggcaucuccgaccgcuucuccggcuccggcuccggcaccgacuucacccucaccaucacccgcgucgagcccgaggacuucgcccucuacuacugccaggucuacggcgccuccuccuacaccuucggccagggcaccaagcucgagcgcaag

SEQ ID NO: 16412 - RNA, 381 nt, Artificial Sequence
  derived and/or modified sequence opt2 from anti-HIV_b12_HeavyChain
cagguccagcucgagcaguccggcgccgaggucaagaagcccggcgccuccgucaaggucuccugccaggccuccggcuaccgcuucucccacuucaccguccacuggguccgccaggcccccggccagcgcuucgaguggaugggcuggaucaaccccuacaacggcaacaaggaguucuccgccaaguuccaggaccgcgucaccuucaccgccgacaccuccgccaacaccgccuacauggagcuccgcucccuccgcuccgccgacaccgccgucuacuacugcgcccgcgucggcgaguggggcugggacgacucccccuacgacaacuacuacauggacgucuggggcaagggcaccaccgucaucgucuccucc

SEQ ID NO: 16413 - RNA, 633 nt, Artificial Sequence
  derived and/or modified sequence opt2 from anti-HIV_2G12_LightChain
gucgucaugacccagucccccuccacccucuccgccuccgucggcgacaccaucaccaucaccugccgcgccucccaguccaucgagaccuggcucgccugguaccagcagaagcccggcaaggcccccaagcuccucaucuacaaggccuccacccucaagaccggcguccccucccgcuucuccggcuccggcuccggcaccgaguucacccucaccaucuccggccuccaguucgacgacuucgccaccuaccacugccagcacuacgccggcuacuccgccaccuucggccagggcacccgcgucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggc

SEQ ID NO: 16414 - RNA, 672 nt, Artificial Sequence
  derived and/or modified sequence opt2 from anti-HIV_2G12_HeavyChain
gagguccagcucgucgaguccggcggcggccucgucaaggccggcggcucccucauccucuccugcggcgucuccaacuuccgcaucuccgcccacaccaugaacuggguccgccgcguccccggcggcggccucgagugggucgccuccaucuccaccuccuccaccuaccgcgacuacgccgacgccgucaagggccgcuucaccgucucccgcgacgaccucgaggacuucgucuaccuccagaugcacaagaugcgcgucgaggacaccgccaucuacuacugcgcccgcaagggcuccgaccgccucuccgacaacgaccccuucgacgccuggggccccggcaccgucgucaccgucucccccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 16415 - RNA, 642 nt, Artificial Sequence
  derived and/or modified sequence opt2 from anti-HIV_4E10_LightChain
gagaucguccucacccagucccccggcacccagucccucucccccggcgagcgcgccacccucuccugccgcgccucccaguccgucggcaacaacaagcucgccugguaccagcagcgccccggccaggccccccgccuccucaucuacggcgccuccucccgccccuccggcgucgccgaccgcuucuccggcuccggcuccggcaccgacuucacccucaccaucucccgccucgagcccgaggacuucgccgucuacuacugccagcaguacggccagucccucuccaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgag

SEQ ID NO: 16416 - RNA, 684 nt, Artificial Sequence
  derived and/or modified sequence opt2 from anti-HIV_4E10_HeavyChain
cagguccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcuggggcuggcucggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 16417 - RNA, 312 nt, Artificial Sequence
  derived and/or modified sequence opt2 from anti-HIV_VRC01_LightChain
gagaucguccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacaaccucaccaucuccaaccucgaguccggcgacuucggcgucuacuacugccagcaguacgaguucuucggccagggcaccaagguccaggucgacaucaagcgc

SEQ ID NO: 16418 - RNA, 363 nt, Artificial Sequence
  derived and/or modified sequence opt2 from anti-HIV_VRC01_HeavyChain
cagguccagcucguccaguccggcggccagaugaagaagcccggcgaguccaugcgcaucuccugccgcgccuccggcuacgaguucaucgacugcacccucaacuggauccgccucgcccccggcaagcgccccgaguggaugggcuggcucaagccccgcggcggcgccgucaacuacgcccgcccccuccagggccgcgucaccaugacccgcgacgucuacuccgacaccgccuuccucgagcuccgcucccucaccgucgacgacaccgccgucuacuucugcacccgcggcaagaacugcgacuacaacugggacuucgagcacuggggccgcggcacccccgucaucgucuccucc

SEQ ID NO: 16419 - RNA, 330 nt, Artificial Sequence
  derived and/or modified sequence opt2 from anti-HIV_PG9_LightChain
caguccgcccucacccagcccgccuccgucuccggcucccccggccaguccaucaccaucuccugcaacggcaccuccaacgacgucggcggcuacgaguccgucuccugguaccagcagcaccccggcaaggcccccaaggucgucaucuacgacgucuccaagcgccccuccggcgucuccaaccgcuucuccggcuccaaguccggcaacaccgccucccucaccaucuccggccuccaggccgaggacgagggcgacuacuacugcaagucccucaccuccacccgccgccgcgucuucggcaccggcaccaagcucaccguccuc

SEQ ID NO: 16420 - RNA, 408 nt, Artificial Sequence
  derived and/or modified sequence opt2 from anti-HIV_PG9_HeavyChain
cagcgccucgucgaguccggcggcggcgucguccagcccggcuccucccuccgccucuccugcgccgccuccggcuucgacuucucccgccagggcaugcacuggguccgccaggcccccggccagggccucgagugggucgccuucaucaaguacgacggcuccgagaaguaccacgccgacuccgucuggggccgccucuccaucucccgcgacaacuccaaggacacccucuaccuccagaugaacucccuccgcgucgaggacaccgccaccuacuucugcguccgcgaggccggcggccccgacuaccgcaacggcuacaacuacuacgacuucuacgacggcuacuacaacuaccacuacauggacgucuggggcaagggcaccaccgucaccgucuccucc

SEQ ID NO: 16421 - RNA, 630 nt, Artificial Sequence
  derived and/or modified sequence opt2 from anti-HIV_VRC07_LightChain
gagaucguccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacacccucaccaucuccaaccucgaguccggcgacuucggcgucuacuacugccagcaguacgaguucuucggccagggcaccaagguccaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccuccgcucccccgucaccaaguccuucaaccgcggcgagugc

SEQ ID NO: 16422 - RNA, 375 nt, Artificial Sequence
  derived and/or modified sequence opt2 from anti-HIV_VRC07_HeavyChain
cagguccagcucguccaguccggcggccagaugaagaagcccggcgaguccaugcgcaucuccugccgcgccuccggcuacgaguucaucgacugcacccucaacuggauccgccucgcccccggcaagcgccccgaguggaugggcuggcucaagccccgcggcggcgccgucaacuacgcccgcccccuccagggccgcgucaccaugacccgcgacgucuacuccgacaccgccuuccucgagcuccgcucccucaccuccgacgacaccgccgucuacuucugcacccgcggcaaguacugcaccgcccgcgacuacuacaacugggacuucgagcacuggggccagggcacccccgucaucgucuccucc

SEQ ID NO: 16423 - RNA, 315 nt, Artificial Sequence
  derived and/or modified sequence opt2 from anti-HIV_3BNC117_LightChain
gacauccagaugacccagucccccuccucccucuccgccuccgucggcgacaccgucaccaucaccugccaggccaacggcuaccucaacugguaccagcagcgccgcggcaaggcccccaagcuccucaucuacgacggcuccaagcucgagcgcggcguccccucccgcuucuccggccgccgcuggggccaggaguacaaccucaccaucaacaaccuccagcccgaggacaucgccaccuacuucugccaggucuacgaguucgucguccccggcacccgccucgaccucaagcgcaccgucgccgccccc

SEQ ID NO: 16424 - RNA, 387 nt, Artificial Sequence
  derived and/or modified sequence opt2 from anti-HIV_3BNC117_HeavyChain
cagguccagcuccuccaguccggcgccgccgucaccaagcccggcgccuccguccgcgucuccugcgaggccuccggcuacaacauccgcgacuacuucauccacugguggcgccaggcccccggccagggccuccagugggucggcuggaucaaccccaagaccggccagcccaacaacccccgccaguuccagggccgcgucucccucacccgccacgccuccugggacuucgacaccuucuccuucuacauggaccucaaggcccuccgcuccgacgacaccgccgucuacuucugcgcccgccagcgcuccgacuacugggacuucgacgucuggggcuccggcacccaggucaccgucuccuccgccuccaccaagggcccc

SEQ ID NO: 16425 - RNA, 324 nt, Artificial Sequence
  derived and/or modified sequence opt2 from anti-HIV_10-1074_LightChain
uccuacguccgcccccucuccgucgcccucggcgagaccgcccgcaucuccugcggccgccaggcccucggcucccgcgccguccagugguaccagcaccgccccggccaggcccccauccuccucaucuacaacaaccaggaccgccccuccggcauccccgagcgcuucuccggcacccccgacaucaacuucggcacccgcgccacccucaccaucuccggcgucgaggccggcgacgaggccgacuacuacugccacaugugggacucccgcuccggcuucuccugguccuucggcggcgccacccgccucaccguccuc

SEQ ID NO: 16426 - RNA, 396 nt, Artificial Sequence
  derived and/or modified sequence opt2 from anti-HIV_10-1074_HeavyChain
cagguccagcuccaggaguccggccccggccucgucaagcccuccgagacccucuccgucaccugcuccgucuccggcgacuccaugaacaacuacuacuggaccuggauccgccagucccccggcaagggccucgaguggaucggcuacaucuccgaccgcgaguccgccaccuacaaccccucccucaacucccgcgucgucaucucccgcgacaccuccaagaaccagcucucccucaagcucaacuccgucacccccgccgacaccgccgucuacuacugcgccaccgcccgccgcggccagcgcaucuacggcgucgucuccuucggcgaguucuucuacuacuacuccauggacgucuggggcaagggcaccaccgucaccgucuccucc

SEQ ID NO: 16427 - RNA, 633 nt, Artificial Sequence
  derived and/or modified sequence opt2 from anti-HIV_PGT121_LightChain
uccgacaucuccgucgcccccggcgagaccgcccgcaucuccugcggcgagaagucccucggcucccgcgccguccagugguaccagcaccgcgccggccaggcccccucccucaucaucuacaacaaccaggaccgccccuccggcauccccgagcgcuucuccggcucccccgacucccccuucggcaccaccgccacccucaccaucaccuccgucgaggccggcgacgaggccgacuacuacugccacaucugggacucccgcguccccaccaagugggucuucggcggcggcaccacccucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugcucc

SEQ ID NO: 16428 - RNA, 705 nt, Artificial Sequence
  derived and/or modified sequence opt2 from anti-HIV_PGT121_HeavyChain
cagaugcagcuccaggaguccggccccggccucgucaagcccuccgagacccucucccucaccugcuccgucuccggcgccuccaucuccgacuccuacugguccuggauccgccgcucccccggcaagggccucgaguggaucggcuacguccacaaguccggcgacaccaacuacucccccucccucaagucccgcgucaaccucucccucgacaccuccaagaaccaggucucccucucccucgucgccgccaccgccgccgacuccggcaaguacuacugcgcccgcacccuccacggccgccgcaucuacggcaucgucgccuucaacgagugguucaccuacuucuacauggacgucuggggcaacggcacccaggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugc

SEQ ID NO: 16429 - RNA, 657 nt, Artificial Sequence
  derived and/or modified sequence opt2 from anti-HIV_PGDM1400_LightChain
gacuucguccucacccaguccccccacucccucuccgucacccccggcgaguccgccuccaucuccugcaaguccucccacucccucauccacggcgaccgcaacaacuaccucgccugguacguccagaagcccggccgcuccccccagcuccucaucuaccucgccuccucccgcgccuccggcguccccgaccgcuucuccggcuccggcuccgacaaggacuucacccucaagaucucccgcgucgagaccgaggacgucggcaccuacuacugcaugcagggccgcgagucccccuggaccuucggccagggcaccaaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16430 - RNA, 735 nt, Artificial Sequence
  derived and/or modified sequence opt2 from anti-HIV_PGDM1400_HeavyChain
caggcccagcucguccaguccggccccgagguccgcaagcccggcaccuccgucaaggucuccugcaaggcccccggcaacacccucaagaccuacgaccuccacuggguccgcuccguccccggccagggccuccaguggaugggcuggaucucccacgagggcgacaagaaggucaucgucgagcgcuucaaggccaaggucaccaucgacugggaccgcuccaccaacaccgccuaccuccagcucuccggccucaccuccggcgacaccgccgucuacuacugcgccaagggcuccaagcaccgccuccgcgacuacgcccucuacgacgacgacggcgcccucaacugggccgucgacgucgacuaccucuccaaccucgaguucuggggccagggcaccgccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgac

SEQ ID NO: 16431 - RNA, 630 nt, Artificial Sequence
  derived and/or modified sequence opt2 from anti-HIV_N6_LightChain
uacauccacgucacccagucccccuccucccucuccgucuccaucggcgaccgcgucaccaucaacugccagaccucccagggcgucggcuccgaccuccacugguaccagcacaagcccggccgcgcccccaagcuccucauccaccacaccuccuccgucgaggacggcguccccucccgcuucuccggcuccggcuuccacaccuccuucaaccucaccaucuccgaccuccaggccgacgacaucgccaccuacuacugccagguccuccaguucuucggccgcggcucccgccuccacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16432 - RNA, 675 nt, Artificial Sequence
  derived and/or modified sequence opt2 from anti-HIV_N6_HeavyChain
cgcgcccaccucguccaguccggcaccgccaugaagaagcccggcgccuccguccgcgucuccugccagaccuccggcuacaccuucaccgcccacauccucuucugguuccgccaggcccccggccgcggccucgagugggucggcuggaucaagccccaguacggcgccgucaacuucggcggcggcuuccgcgaccgcgucacccucacccgcgacgucuaccgcgagaucgccuacauggacauccgcggccucaagcccgacgacaccgccgucuacuacugcgcccgcgaccgcuccuacggcgacuccuccugggcccucgacgccuggggccagggcaccaccgucgucgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16433 - RNA, 1080 nt, Artificial Sequence
  derived and/or modified sequence opt2 from anti-HIV_N6_GChain
gccugggaggacgccgacaccacccucuucugcgccuccgacgccaaggccuacuccaccgagaagcacaacgucugggccacccacgccugcguccccaccgaccccgacccccaggagaucccccucgagaacgucaccgagaacuucaacauguggaagaacaacauggucgagcagaugcacgaggacaucaucucccucugggacgagucccucaagcccugcgucaugcucaccggcggcuccaccaucaagcaggccugccccaaggucaccuucgagcccauccccauccacuacugcgcccccgccggcuucgccauccucaagugccgcgacgaggacuucaacggcaccggccccugcaagaacgucuccaccguccagugcacccacggcaucaagcccgucgucuccacccagcuccuccucaacggcucccucgccaagggcgacaucgucauccgcuccgagaaccucaccaacaacgccaaggucaucaucguccagcucaacgagcccguccagaucgucugcauccgccccaacaacggcggcuccggcuccggcggcgacauccgccaggcccacugcaacgucacccgcggcaagugggucaacaucaccaagaacgucaaggagcagcucuggaagaucuucaacaagaccaccaacaucaccuucaacaacaccaucuucaacucccccgccggcggcgaccucgagaucaccacccacuccuucaacugcggcggcgaguucuucuacugcaacaccuccgaccucuucaacgagaccaaccucuccgccaaccacaccgacaccaacgagaacaucacccuccagugccgcaucaagcagaucguccgcauguggcagcgcgucggccaggccauguacgccccccccaucgccggcaacaucaccugcaucuccaacaucaccggccuccuccucacccgcgacggcgucaacgacacccacgacaaggagaacgagaccuuccgccccaccggcggcgacaugcgcgacaacuggcgcuccgagcucuacaaguacaaggucaucaagcucaag

SEQ ID NO: 16434 - RNA, 645 nt, Artificial Sequence
  derived and/or modified sequence opt2 from anti-HIV_10E8_LightChain
uccuacgagcucacccaggagaccggcgucuccgucgcccucggccgcaccgucaccaucaccugccgcggcgacucccuccgcucccacuacgccuccugguaccagaagaagcccggccaggcccccauccuccucuucuacggcaagaacaaccgccccuccggcguccccgaccgcuucuccggcuccgccuccggcaaccgcgccucccucaccaucuccggcgcccaggccgaggacgacgccgaguacuacugcuccucccgcgacaaguccggcucccgccucuccgucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16435 - RNA, 708 nt, Artificial Sequence
  derived and/or modified sequence opt2 from anti-HIV_10E8_HeavyChain
gagguccagcucgucgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccgcggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaag

SEQ ID NO: 16436 - RNA, 333 nt, Artificial Sequence
  derived and/or modified sequence opt2 from anti-HIV_12A12_LightChain
gacauccagaugacccagucccccuccucccucuccgccuccgucggcgaccgcgucaccaucaccugccaggccggccagggcaucggcuccucccuccagugguaccagcagaagcccggcaaggcccccaagcuccucguccacggcgccuccaaccuccaccgcggcguccccucccgcuucuccggcuccggcuuccacaccaccuucucccucaccaucuccggccuccagcgcgacgacuucgccaccuacuucugcgccguccucgaguucuucggccccggcaccaaggucgagaucaagcgcaccgucgccgcccccuccguc

SEQ ID NO: 16437 - RNA, 381 nt, Artificial Sequence
  derived and/or modified sequence opt2 from anti-HIV_12A12_HeavyChain
ucccagcaccucguccaguccggcacccaggucaagaagcccggcgccuccguccgcaucuccugccaggccuccggcuacuccuucaccgacuacguccuccacugguggcgccaggcccccggccagggccucgaguggaugggcuggaucaagcccgucuacggcgcccgcaacuacgcccgccgcuuccagggccgcaucaacuucgaccgcgacaucuaccgcgagaucgccuucauggaccucuccggccuccgcuccgacgacaccgcccucuacuucugcgcccgcgacggcuccggcgacgacaccuccuggcaccucgaccccuggggccagggcacccucgucaucgucuccgccgccuccaccaagggc

SEQ ID NO: 16438 - RNA, 315 nt, Artificial Sequence
  derived and/or modified sequence opt2 from anti-HIV_12A21_LightChain
gacauccagaugacccagucccccuccucccucuccgccuccgucggcgaccgcgucaccaucaacugccaggccggccagggcaucggcuccucccucaacugguaccagaagaagcccggccgcgcccccaagcuccucguccacggcgccuccaaccuccagcgcggcguccccucccgcuucuccggcuccggcuuccacaccaccuucacccucaccaucuccucccuccagcccgacgacgucgccaccuacuucugcgccgucuuccagugguucggccccggcaccaaggucgacaucaagcgcacc

SEQ ID NO: 16439 - RNA, 384 nt, Artificial Sequence
  derived and/or modified sequence opt2 from anti-HIV_12A21_HeavyChain
ucccagcaccucguccaguccggcacccaggucaagaagcccggcgccuccguccgcgucuccugccaggccuccggcuacaccuucaccaacuacauccuccacugguggcgccaggcccccggccagggccucgaguggaugggccucaucaagcccgucuucggcgccgucaacuacgcccgccaguuccagggccgcauccagcucacccgcgacaucuaccgcgagaucgccuuccucgaccucuccggccuccgcuccgacgacaccgccgucuacuacugcgcccgcgacgaguccggcgacgaccucaaguggcaccuccaccccuggggccagggcacccaggucaucgucucccccgccuccaccaagggcccc

SEQ ID NO: 16440 - RNA, 648 nt, Artificial Sequence
  derived and/or modified sequence opt2 from anti-HIV_35022_LightChain
caguccguccucacccaguccgccuccgucuccggcucccucggccaguccgucaccaucuccugcaccggccccaacuccgucugcugcucccacaaguccaucuccugguaccaguggccccccggccgcgcccccacccucaucaucuacgaggacaacgagcgcgcccccggcaucuccccccgcuucuccggcuacaaguccuacugguccgccuaccucaccaucuccgaccuccgccccgaggacgagaccaccuacuacugcugcuccuacacccacaacuccggcugcgucuucggcaccggcaccaaggucuccguccucggccaguccaaggccaaccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16441 - RNA, 729 nt, Artificial Sequence
  derived and/or modified sequence opt2 from anti-HIV_35022_HeavyChain
gagggccagcucguccaguccggcgccgagcucaagaagcccggcgccuccgucaagaucuccugcaagaccuccggcuaccgcuucaacuucuaccacaucaacuggauccgccagaccgccggccgcggccccgaguggaugggcuggaucucccccuacuccggcgacaagaaccucgcccccgccuuccaggaccgcgucaucaugaccaccgacaccgagguccccgucaccuccuucaccuccaccggcgccgccuacauggagauccgcaaccucaaguucgacgacaccggcaccuacuucugcgccaagggccuccuccgcgacggcuccuccaccuggcuccccuaccucuggggccagggcacccuccucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagggccucgagguccucuuccag

SEQ ID NO: 16442 - RNA, 648 nt, Artificial Sequence
  derived and/or modified sequence opt2 from anti-HIV_3BC176_LightChain
caguccguccucacccagcccgccuccgucuccgccucccccggccaguccaucaccgucuccugcaccggcucccgcaacgacgucggcggcuacgacuucgucuccugguaccagcgccaccccggcggcguccccaagcucaucaucuacgagaucuccaagcgccccuccggcaucccccagcgcuucuccggcucccgcuccggcaacaccgccucccucaccaucuccggccuccaggacgacgacgaggccgacuacuacugcugcuccuacgccuccuacgaccgccucaucuucggcggcggcacccgcgucuccguccuccgccagcccaaggccgcccccuccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16443 - RNA, 699 nt, Artificial Sequence
  derived and/or modified sequence opt2 from anti-HIV_3BC176_HeavyChain
gagcagguccagcucaugcaguccggcgcccagcuccgcgaccccggcgacucccucaagaucuccugcaaggccuccggcuacaacuucaucgacuaccacauccacuggguccgccucgcccccggccgcggccucgaguggaugggcuggaucgaccccgucggcggcaucaccaaguacgccggccaguuccagggccgccucucccucacccgcgacaccuccaccaacacccucuuccucgagcucucccgccucaccgccggcgacaccgccgucuacuucugcgcccgcuccaugcgccccgucgaccacggcaucgacuacuccggccucuucgucuuccacuucuggggccgcggcuccgacguccucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgac

SEQ ID NO: 16444 - RNA, 621 nt, Artificial Sequence
  derived and/or modified sequence opt2 from anti-HIV_3BNC55_LightChain
gacauccagaugacccagucccccuccucccucuccgccuccgucggcgacaaggucaccaucaccugccagaccuccgccggcuaccucaacugguaccagcagcgccgcggccgcgcccccaagcuccucauguacgacggcucccgccucgucaccggcguccccucccgcuucuccggccgccgcuggggcacccaguacaaccucaccaucggcucccuccagcccgaggacaucgccaccuacuacugccaggucuacgaguucuucggccccggcacccgccucgaccucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16445 - RNA, 675 nt, Artificial Sequence
  derived and/or modified sequence opt2 from anti-HIV_3BNC55_HeavyChain
cagguccagcucguccaguccggcaccgccgucaagcgccccggcgccuccguccgcgucuccugccaggccuccggcuacaccuucaccgacuacuucaucuacugguggcgccaggcccccggccagggccucgaguggcucggcuggaucaacccccucaccucccagcccuccuaccccucccgcuuccagggccgccucacccucacccgcgacaccuucgacgagaugcucuacauggaccuccgcggccuccgcuccgacgacaccggcaucuacuucugcgcccgccgccacuccgacuacugcgacuucgacaucuggggcuccggcacccagaucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacc

SEQ ID NO: 16446 - RNA, 618 nt, Artificial Sequence
  derived and/or modified sequence opt2 from anti-HIV_3BNC60_LightChain
gacauccagaugacccagucccccuccucccucuccgcccgcgucggcgacaccgucaccaucaccugccaggccaacggcuaccucaacugguaccagcagcgccgcggcaaggcccccaagcuccucaucuacgacggcuccaagcucgagcgcggcguccccgcccgcuucuccggccgccgcuggggccaggaguacaaccucaccaucaacaaccuccagcccgaggacgucgccaccuacuucugccaggucuacgaguucaucguccccggcacccgccucgaccucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16447 - RNA, 687 nt, Artificial Sequence
  derived and/or modified sequence opt2 from anti-HIV_3BNC60_HeavyChain
cagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacccccgccaguuccagggccgcgucucccucacccgccaggccuccugggacuucgacaccuacuccuucuacauggaccucaaggccguccgcuccgacgacaccgccaucuacuucugcgcccgccagcgcuccgacuucugggacuucgacgucuggggcuccggcacccaggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacc

SEQ ID NO: 16448 - RNA, 687 nt, Artificial Sequence
  derived and/or modified sequence opt2 from anti-HIV_3BNC60_HeavyChain
gagguccaccucucccaguccggcgccgccgucaccaagcccggcgccuccguccgcgucuccugcgaggccuccggcuacaagaucuccgaccacuucauccacugguggcgccaggcccccggccagggccuccagugggucggcuggaucaaccccaagaccggccagcccaacaacgcccgccaguuccagggccgcgucucccucacccgccaggccuccugggacuucgacaccuacuccuucuacauggaccucaaggccguccgcuccgacgacaccgccaucuacuucugcgcccgccagcgcuccgacuucugggacuucgacgucuggggcuccggcacccaggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacc

SEQ ID NO: 16449 - RNA, 648 nt, Artificial Sequence
  derived and/or modified sequence opt2 from anti-HIV_447-52D_LightChain
caguccguccucacccagccccccuccgucuccgccgcccccggccagaaggucaccaucuccugcuccggcuccuccuccaacaucggcaacaacuacguccucugguaccagcaguuccccggcaccgcccccaagcuccucaucuacggcaacaacaagcgccccuccggcauccccgaccgcuucuccggcuccaaguccggcaccuccgccacccucggcaucaccggccuccagaccggcgacgaggccgacuacuucugcgccaccugggacuccggccucuccgccgacugggucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugc

SEQ ID NO: 16450 - RNA, 693 nt, Artificial Sequence
  derived and/or modified sequence opt2 from anti-HIV_447-52D_HeavyChain
gagguccagcucgucgaguccggcggcggccucgucaagcccggcggcucccuccgccucaccugcgucgccuccggcuucaccuucuccgacgucuggcucaacuggguccgccaggcccccggcaagggccucgagugggucggccgcaucaagucccgcaccgacggcggcaccaccgacuacgccgccuccgucaagggccgcuucaccaucucccgcgacgacuccaagaacacccucuaccuccagaugaacucccucaagaccgaggacaccgccgucuacuccugcaccaccgacggcuucaucaugauccgcggcgucuccgaggacuacuacuacuacuacauggacgucuggggcaagggcaccaccgucaccgucuccuccgccuccaccaagggccccuccgucuucccccucgcccccugcucccgcuccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucaaccacaagcccuccaacaccaaggucgacaagcgcgucgagcuc

SEQ ID NO: 16451 - RNA, 645 nt, Artificial Sequence
  derived and/or modified sequence opt2 from anti-HIV_447-52D_LightChain
caguccguccucacccagccccccuccgucuccgccgcccccggccagaaggucaccaucuccugcuccggcuccuccuccaacaucggcaacaacuacguccucugguaccagcaguuccccggcaccgcccccaagcuccucaucuacggcaacaacaagcgccccuccggcauccccgaccgcuucuccggcuccaaguccggcaccuccgccacccucggcaucaccggccuccagaccggcgacgaggccgacuacuucugcgccaccugggacuccggccucuccgccgacugggucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgag

SEQ ID NO: 16452 - RNA, 705 nt, Artificial Sequence
  derived and/or modified sequence opt2 from anti-HIV_447-52D_HeavyChain
gagguccagcucgucgaguccggcggcggccucgucaagcccggcggcucccuccgccucaccugcgucgccuccggcuucaccuucuccgacgucuggcucaacuggguccgccaggcccccggcaagggccucgagugggucggccgcaucaagucccgcaccgacggcggcaccaccgacuacgccgccuccgucaagggccgcuucaccaucucccgcgacgacuccaagaacacccucuaccuccagaugaacucccucaagaccgaggacaccgccgucuacuccugcaccaccgacggcuucaucaugauccgcggcgucuccgaggacuacuacuacuacuacauggacgucuggggcaagggcaccaccgucaccgucuccuccgccuccaccaagggccccuccgucuucccccucgcccccugcucccgcuccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaccugcaacgucaaccacaagcccuccaacaccaaggucgacaagcgcgucgagcucaagacccccacc

SEQ ID NO: 16453 - RNA, 624 nt, Artificial Sequence
  derived and/or modified sequence opt2 from anti-HIV_5H/I1-BMV-D5_LightChain
gacauccagaugacccagucccccuccacccucuccgccuccaucggcgaccgcgucaccaucaccugccgcgccuccgagggcaucuaccacuggcucgccugguaccagcagaagcccggcaaggcccccaagcuccucaucuacaaggccuccucccucgccuccggcgcccccucccgcuucuccggcuccggcuccggcaccgacuucacccucaccaucuccucccuccagcccgacgacuucgccaccuacuacugccagcaguacuccaacuacccccucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaagucc

SEQ ID NO: 16454 - RNA, 651 nt, Artificial Sequence
  derived and/or modified sequence opt2 from anti-HIV_5H/I1-BMV-D5_HeavyChain
cagguccagcucguccaguccggcgccgagguccgcaagcccggcgccuccgucaaggucuccugcaaggccuccggcgacaccuucuccuccuacgccaucuccuggguccgccaggcccccggccagggccucgaguggaugggcggcaucauccccaucuucggcaccgccaacuacgcccaggccuuccagggccgcgucaccaucaccgccaacgaguccaccuccaccgccuacauggagcucuccucccuccgcuccgaggacaccgccaucuacuacugcgcccgcgacaaccccacccuccucggcuccgacuacuggggcgccggcacccucgucaccgucuccuccgccuccaccaagggccccuccgucuucccccucgcccccugcucccgcuccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcguc

SEQ ID NO: 16455 - RNA, 657 nt, Artificial Sequence
  derived and/or modified sequence opt2 from anti-HIV_5H/I1-BMV-D5_A-Chain
augcagcuccucuccggcaucguccagcagcagaacaaccuccuccgcgccaucgaggcccagcagcaccuccuccagcucaccgucuggggcaucaagcagcuccaggcccgcauccucgccggcggcuccggcggccacaccaccuggauggagugggaccgcgagaucaacaacuacaccucccucauccacucccucaucgaggagucccagaaccagcaggagaagaacgagcaggagcuccucgagggcuccuccggcggccagcuccucuccggcaucguccagcagcagaacaaccuccuccgcgccaucgaggcccagcagcaccuccuccagcucaccgucuggggcaucaagcagcuccaggcccgcauccucgccggcggcuccggcggccacaccaccuggauggagugggaccgcgagaucaacaacuacaccucccucauccacucccucaucgaggagucccagaaccagcaggagaagaacgagcaggagcuccucgagggcuccuccggcggccagcuccucuccggcaucguccagcagcagaacaaccuccuccgcgccaucgaggcccagcagcaccuccuccagcucaccgucuggggcaucaagcagcuccaggcccgcauccucgccggcggc

SEQ ID NO: 16456 - RNA, 390 nt, Artificial Sequence
  derived and/or modified sequence opt2 from anti-HIV_8ANC195_LightChain
gacauccagaugacccagucccccuccacccucuccgccuccaucggcgacaccguccgcaucuccugccgcgccucccaguccaucaccggcaacugggucgccugguaccagcagcgccccggcaaggccccccgccuccucaucuaccgcggcgccgcccuccucggcggcguccccucccgcuucuccggcuccgccgccggcaccgacuucacccucaccaucggcaaccuccaggccgaggacuucggcaccuucuacugccagcaguacgacaccuaccccggcaccuucggccagggcaccaaggucgaggucaagcgcaccgucgccgcccccuccgucuucaucuucccccccuccgacgagcagcucaaguccggcacc

SEQ ID NO: 16457 - RNA, 423 nt, Artificial Sequence
  derived and/or modified sequence opt2 from anti-HIV_8ANC195_HeavyChain
cagauccaccucguccaguccggcaccgaggucaagaagcccggcuccuccgucaccgucuccugcaaggccuacggcgucaacaccuucggccucuacgccgucaacuggguccgccaggcccccggccagucccucgaguacaucggccagaucuggcgcuggaaguccuccgccucccaccacuuccgcggccgcguccucaucuccgccgucgaccucaccggcuccuccccccccaucuccucccucgagaucaagaaccucaccuccgacgacaccgccgucuacuucugcaccaccaccuccaccuacgacaagugguccggccuccaccacgacggcgucauggccuucuccuccuggggccagggcacccucaucuccgucuccgccgccuccaccaagggccccuccgucuuc

SEQ ID NO: 16458 - RNA, 333 nt, Artificial Sequence
  derived and/or modified sequence opt2 from anti-HIV_CAP256-VRC26.01_LightChain
caguccguccucacccagccccccuccgucuccgccgcccccggccagaaggucaccaucuccugcuccggcuccuccuccaccaucggcaacaacuacgucuccugguaccgccuccuccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 16459 - RNA, 432 nt, Artificial Sequence
  derived and/or modified sequence opt2 from anti-HIV_CAP256-VRC26.01_HeavyChain
gagguccaggucgucgaguccggcggcggcgucguccagcccggccgcucccuccgccucuccugcaccgccuccggcuucaccuucuccaacuucgccaugggcuggguccgccaggcccccggcaagggccucgagugggucgccuucaucuccuccgacggcuccaacaagaacuacggcgacuccgucaagggccgcuucaccaucucccgcgacaacuccaagaacaccgucuuccuccagaugaacucccuccgcgucgaggacaccgcccucuacuacugcgccaaggacgucggcgacuacaaguccgacgaguggggcaccgaguacuacgacaucuccaucuccuaccccauccaggacccccgcgccauggucggcgccuucgaccucuggggccagggcaccauggucaccgucuccccc

SEQ ID NO: 16460 - RNA, 324 nt, Artificial Sequence
  derived and/or modified sequence opt2 from anti-HIV_CAP256-VRC26.02_LightChain
caguccguccucacccagccccccuccgucuccgccgcccccggccagaaggucaccaucuccugcuccggcuccaacuccaacaucggcaacaaggacgucuccugguaccagcagauccccgccaccgcccccaagcuccucaucuacgagaacaacaagcgccccuccggcaucuccgaccgcuucuccggcuccaaguccggcaccuccgccacccucgccaucaccggccuccagaccggcgacgaggccgacuacuacugcgccaccugggacggccgcgucuccgucaucggcaccggcaccaacgucaucguccuc

SEQ ID NO: 16461 - RNA, 432 nt, Artificial Sequence
  derived and/or modified sequence opt2 from anti-HIV_CAP256-VRC26.02_HeavyChain
gagguccagcucgucgaguccggcggcggcgucguccagcccggccgcucccuccgccucuccugcgccgccucccaguucuccuucggcaacuacggcaugcacuggguccgccaggcccccggcaagggccucgagugggucgccgccaucuccuucgccggcaccaagaccaacuacgccgacuccgucaagggccgcuucaccaucucccgcgacaacuccaagaacaccgucuaccuccagaugaacucccuccgcgccgaggacaccgcccucuacuucugcgccaaggacauccgcgaguacgagugcgaguacuggaccuccgacuacuacgacuucggccgcccccagcccugcaucgacucccgcggcgucgucggcaccuucgacgucuggggccagggcaccauggucaccgucuccucc

SEQ ID NO: 16462 - RNA, 333 nt, Artificial Sequence
  derived and/or modified sequence opt2 from anti-HIV_CAP256-VRC26.03_LightChain
caguccguccucacccagccccccuccgucuccgccgcccccggccagaaggucaccaucuccugcuccggcuccuccuccaacaucggcaacaacuucgucuccugguaccagcagcgccccggcaccgcccccaagauccucaucuacgagaacaacaagcgccccuccgagacccccgaccgcuucuccggcuccaaguccggcaccuccgccacccucgccaucaccggccuccagaccgccgacgaggccgaguacuacugcgccaccugguccgccucccucuccuccgcccgcgucuucggcaccggcacccgcaucaccguccuc

SEQ ID NO: 16463 - RNA, 432 nt, Artificial Sequence
  derived and/or modified sequence opt2 from anti-HIV_CAP256-VRC26.03_HeavyChain
gagguccagcucgucgaguccggcggcggcgucguccagcccggcaagucccuccgccucuccugcgccgccucccgcuucuccuucaaccgcuacggcaugcacuggguccgccaggcccccggcaagggccucgagugggucgccgccaucuccuacgacggcaccgacaaguaccacgccgacaaggucuggggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggcaagcagcuccccugccgcaagucccgcggcgucgccggcaucuucgacggcuggggccagggcaccauggucaccgucuccucc

SEQ ID NO: 16464 - RNA, 333 nt, Artificial Sequence
  derived and/or modified sequence opt2 from anti-HIV_CAP256-VRC26.04_LightChain
cagcccguccucacccagccccccuccgucuccgccgcccccggccagaaggucaccaucuccugcuccggcuccuccuccaacaucggcaacaacuucgucuccugguaccagcagcgccccggcaccgcccccucccuccucaucuacgagaccaacaagcgccccuccggcauccccgaccgcuucuccggcuccaaguccgccaccuccgccacccucgccaucaccggccuccagaccggcgacgaggccgacuacuacugcgccaccugggccgccucccucaccuccgcccgcgucuucggcaccggcaccaaggucaucgucucc

SEQ ID NO: 16465 - RNA, 432 nt, Artificial Sequence
  derived and/or modified sequence opt2 from anti-HIV_CAP256-VRC26.04_HeavyChain
gagguccagcucgucgaguccggcggcggcgucguccagcccggcaagucccuccgccucuccugcgccgccucccaguucuccuucaaccgcuacggcaugcacuggguccgccaggcccccggcaagggccucgagugggucgccgccaucuccuacgacggcaccgacaaguaccacgccgacaaggucuggggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggcaagcagcuccccugccgcaagucccgcggcgucgccggcaucuucgacaaguggggccagggcaccauggucaucgucuccucc

SEQ ID NO: 16466 - RNA, 324 nt, Artificial Sequence
  derived and/or modified sequence opt2 from anti-HIV_CAP256-VRC26.05_LightChain
caguccgcccucacccagccccccuccgucuccgccgcccccggccagaaggucaccaucuccugcuccggcaacaucggcaacaacuacgucuccugguaccagcagguccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccuggggcggcucccuccgcaccggcggcguccucggcaccggcacccgcgucaccguccuc

SEQ ID NO: 16467 - RNA, 432 nt, Artificial Sequence
  derived and/or modified sequence opt2 from anti-HIV_CAP256-VRC26.05_HeavyChain
gagguccagcucgucgaguccggcggcggcgucguccagcccggccgcucccuccgccucuccugcgccgccucccacuucucccucuccuccuacggcaugcacuggguccgccaggcccccggcaagggccucgagugggucaccggcaucuccuucgccggcaccaagaccuacuacggcgacuccguccgcggccgcuucaccgucucccgcgacaucuccaagaacacccucuuccuccagaugaacucccuccgccccgacgacaccgccauguacuacugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 16468 - RNA, 324 nt, Artificial Sequence
  derived and/or modified sequence opt2 from anti-HIV_CAP256-VRC26.06_LightChain
caguccguccucacccagccccccuccgucuccgccgcccccggccagaaggucaccaucuccugcuccggcuccaccuccaagaucggccagaacuccgucuccugguaccagcagcuccccggcaccgcccccaagcuccucaucuacgagaacgaccgccgccccuccggcacccccgaccgcuucuccggcuccaaguccggcaccuccgccacccucgccaucaccggccuccagaccggcgacgaggccgaguacuacugcgagaccugggacggcuccggcggcgucuucggcaccggcaccaaggucaccguccuc

SEQ ID NO: 16469 - RNA, 435 nt, Artificial Sequence
  derived and/or modified sequence opt2 from anti-HIV_CAP256-VRC26.06_HeavyChain
gagguccagcucaucgaguccggcggcggcgucguccagcccggccgcucccuccgccucuccugcggcgccuccggcuucuccuucaacaacuacggcaugcacuggguccgccaggcccccggcaagggccucgagugggucgccggcaucuccuucgccggcaucaagaaguacuacggcaccuccgucaagggccgcuucaccaucucccgcgacaacuccaagaacaacuucuaccuccagaugaacucccuccgcgucgaggacaccgcccucuacuacugcgcccgcgaccuccgcgagcucgagugcgaggaguggacccucuacaacuacuacgacuucggcucccgcggccccugcgucgacccccgcggcgucgccggcuccuucgacgucuggggccagggcaccauggucaccgucuccucc

SEQ ID NO: 16470 - RNA, 333 nt, Artificial Sequence
  derived and/or modified sequence opt2 from anti-HIV_CAP256-VRC26.07_LightChain
caggccguccucacccagccccccuccgucuccgccgcccccggccagaacgucaccaucuccugcuccggcuccggcuccaacaucggcaacaacuucgucuccugguaccagcagcgccccggcaccgcccccaagcuccucaucuacgaguccaacaagcgccccuccggcauccccgaccgcuucuccggcuccaaguccggcaccuccgccacccucgccaucaccggccuccagaccggcgacgaggccuacuacuacugcgccaccugggccgcccgccucaacuccgcccgcgucuucggcaccggcaccauggucaccguccuc

SEQ ID NO: 16471 - RNA, 432 nt, Artificial Sequence
  derived and/or modified sequence opt2 from anti-HIV_CAP256-VRC26.07_HeavyChain
gagguccagcucgucgaguccggcggcggcgucguccagcccggccgcucccuccgccucuccugcgucggcucccaguucuccuucaaccgcuacggcaugcacuggguccgccaggcccccggcaagggccucgagugggucgccggcaucuccuucgacggcaccgaccgcuaccacgccgacaacgucuggggccgcuucaccaucucccgcgacaacuccaagaacacccucuaccuccagauguccucccuccgcgccgaggacaccgcccucuacuacugcgccaaggaccuccgcgaggacgagugcgaggaguggugguccgacuacuacgacuucggcaagaagcuccccugccgcaagucccgcggcgucgccggcgucuucgacaaguggggccagggcaccauggucaccgucuccucc

SEQ ID NO: 16472 - RNA, 333 nt, Artificial Sequence
  derived and/or modified sequence opt2 from anti-HIV_CAP256-VRC26.08_LightChain
caguccgcccucacccagccccccuccgucuccgccgcccccggccagaaggucaccaucuccugcuccggcaacuccuccaacaucggcaacaacuucgucuccugguaccagcagguccccggcaccgcccccaagcuccuccucuacgagaccuaccgccgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 16473 - RNA, 438 nt, Artificial Sequence
  derived and/or modified sequence opt2 from anti-HIV_CAP256-VRC26.08_HeavyChain
gagguccagcucgucgaguccggcggcggcgucguccagcccggccgcucccucacccucuccugcgccgccucccaguucaccuucuccaacuacggcaugcacuggguccgccaggcccccggcaagggccucgagugggucgccuccgucuccaacgacggcaccaagaaguaccacggcgacuccgucuggggccgcuucaccaucucccgcgacaacuccaagaacacccucuuccuccagauguccucccuccgcgccgaggacaccgccgucuacuucugcguccgcgaccagcgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 16474 - RNA, 333 nt, Artificial Sequence
  derived and/or modified sequence opt2 from anti-HIV_CAP256-VRC26.09_LightChain
caguccgcccucacccagccccccuccgucuccgccgcccccggccagaaggucaccaucuccugcuccggcaacuccuccaacaucggcaacaacuucgucuccugguaccagcagcuccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacuggugcgccgucuggggcguccgccgcggcgccggcgccgucuucggcgccggcaccaaggucaccguccuc

SEQ ID NO: 16475 - RNA, 438 nt, Artificial Sequence
  derived and/or modified sequence opt2 from anti-HIV_CAP256-VRC26.09_HeavyChain
gagguccagcucgucgaguccggcggcggcgucguccagcccggccgcucccucacccucuccugcgccgccucccaguucaacuucgccaacuacggcaugcacuggguccgccaggcccccggcaagggccucgagugggucgccuccaucuccaacgacggcaccaagaaguaccacgaggaguccgucuggggccgcuucaccaucuccaaggacaacuccaaguccacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 16476 - RNA, 333 nt, Artificial Sequence
  derived and/or modified sequence opt2 from anti-HIV_CAP256-VRC26.10_LightChain
caguccguccucacccagccccccuccgucuccgccgcccccggccagaaggucaccaucuccugcuccggcuccuccuccaacaucggcgacaacuacgucuccugguaccagcaccuccccggcaccgcccccaagcuccucaucuacgagaacacccgccgccccuccggcauccccgaccgcuucuccggcuccaaguccggcaccuccgccacccucgccaucaccggccuccagaccggcgacgaggccgacuacuacugcggcaccugggacguccgccccaaccgcggcgccgucuucggcaccggcaccaaggucaccguccuc

SEQ ID NO: 16477 - RNA, 432 nt, Artificial Sequence
  derived and/or modified sequence opt2 from anti-HIV_CAP256-VRC26.10_HeavyChain
caggccauccucgucgaguccggcggcggcgucguccagcccggccgcucccuccgccucuccugcgccgccucccaguucaccuucuccggccacggccuccacuggguccgccaggcccccggcaagggccucgagugggucgccuccaucuccuucgccggcaccaagauggacuacgccgacuccgucaagggccgcuucgccaucucccgcgacaacuccaagaacacccucuaccuccagaugaacucccuccgcgucgaggacaccgcccucuacuacugcgccaaggacaugcgcgaguacgagugcgaguacuggaccuccgacuacuacgacuucggccgcccccagcccugcaucgaccgccgcggcgucgucggcaucuucgacauguggggccagggcaccauggucaccgucuccacc

SEQ ID NO: 16478 - RNA, 321 nt, Artificial Sequence
  derived and/or modified sequence opt2 from anti-HIV_CAP256-VRC26.11_LightChain
caguccguccucacccagccccccuccgucuccgccgcccccggccagaacgucaccaucuccugcuccggcccccccucccacaucgagaagaacgacgucuccugguaccagcgccuccccggcauggcccccaagauggucaucuacgaguccaagcgccgcccccucggcauccccguccgcuucuccgccucccgcuccggcuccuccgccacccucgucaucaccggccuccagaccgccgacgaggccgacuacuacugcggcaccugggacggccgcaugaacuucggcaccggcaccaccgucuccguccuc

SEQ ID NO: 16479 - RNA, 429 nt, Artificial Sequence
  derived and/or modified sequence opt2 from anti-HIV_CAP256-VRC26.11_HeavyChain
gagguccagcucgucgaguccggcggcggcgucgucccccccggcaagucccucacccucuccugcgucgccucccgcuucaccuucuccgccuucggcaugcacuggguccgccaggcccccggcaagggccucgagugggucgccuccaucuccuucgccggcaucaagaaguacuacgccgacuccgucaagggccgcuucuccaucucccgcgacaacuccaacacccucuuccuccagaugaacggccuccgcggcgaggacaccggccucuaccacugcgucaaggacaugcgcgagcucgagugcgaggagugggccuccgacuacuacgacuucggcaagccccagcccugccucgaccgccgcggcgucuccggcaucuccgccugguggggccccggcaccauggucaccgucuccucc

SEQ ID NO: 16480 - RNA, 321 nt, Artificial Sequence
  derived and/or modified sequence opt2 from anti-HIV_CAP256-VRC26.12_LightChain
caguccguccucacccagccccccuccgucuccaccgcccccggccagaccgucaccgucuccugcuccggcggcaccuccaacaccggcaacaacuucgucuccugguaccagcaccuccccggcaccgcccccaagcuccucaucuacgagaacaacaagcgcccccucggcguccccgaccgcuucuccggcgccaaguccggcaccuccgccacccucgccaucaccggccuccagaccggcgacgagggcgacuacuacugcgccaccugguccggcucccucaacaucggcaccggcaccaaggucuccguccuc

SEQ ID NO: 16481 - RNA, 432 nt, Artificial Sequence
  derived and/or modified sequence opt2 from anti-HIV_CAP256-VRC26.12_HeavyChain
gagguccagcucguccaguccggcggcggcgucguccagcccggccgcucccuccgccucuccugcgccgcccccuacuucgaguucggccgcuacggcuuccacuggguccgccaggcccccggcaagggccucgagugggucgccuccaucuccuucgccggccgcgacuacuaccacucccccuccgucuggggccgcuucaccaucucccgcgacaacuccaagaacacccucuaccuccagaugaacucccuccgcaucgaggacaccgcccucuacuucugcgcccgcgaccuccgcgaguccgagugcgaggagugggaguccgacuacuacgacuucggcaagaagggccccugcgucaagccccgcggcgucgccggcggccucgaccucuggggccagggcaccauggucaucgucuccucc

SEQ ID NO: 16482 - RNA, 333 nt, Artificial Sequence
  derived and/or modified sequence opt2 from anti-HIV_CAP256-VRC26.I1_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16483 - RNA, 432 nt, Artificial Sequence
  derived and/or modified sequence opt2 from anti-HIV_CAP256-VRC26.I1_HeavyChain
cagguccagcucgucgaguccggcggcggcgucguccagcccggccgcucccuccgccucuccugcgccgccuccggcuucaccuucuccaacuacgccauggacuggguccgccaggcccccggcaagggccucgagugggucgccgucaucuccuccgacggcuccaacaagaacuacgccgacuccgucaagggccgcuucaccaucucccgcgacaacuccaagaacacccucuaccuccagaugaacucccuccgcgccgaggacaccgccgucuacuacugcgccaaggaccucggcgagaacaagaacgacgagugggccaccgacuacuacgaccucuccaucgccuaccccguccaggacccccgcgccgucgucggcgccuucgacaucuggggccagggcaccauggucaccgucuccucc

SEQ ID NO: 16484 - RNA, 333 nt, Artificial Sequence
  derived and/or modified sequence opt2 from anti-HIV_CAP256-VRC26.I2_LightChain
caguccguccucacccagccccccuccgucuccgccgcccccggccagaaggucaccaucuccugcuccggcuccuccuccaccaucggcaacaacuacgucuccugguaccagcuccuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16485 - RNA, 432 nt, Artificial Sequence
  derived and/or modified sequence opt2 from anti-HIV_CAP256-VRC26.I2_HeavyChain
cagguccagcucgucgaguccggcggcggcgucguccagcccggccgcucccuccgccucuccugcgccgccuccggcuucaccuucuccaacuucgccaugggcuggguccgccaggcccccggcaagggccucgagugggucgccuucaucuccuccgacggcuccaacaagaacuacggcgacuccgucaagggccgcuucaccaucucccgcgacaacuccaagaacacccucuuccuccagaugaacucccuccgcgccgaggacaccgcccucuacuacugcgccaaggacgucggcgaguacaaguccgacgagugggccaccgacuacuacgaccucuccaucgccuaccccauccaggacccccgcgccauggucggcgccuucgacaucuggggccagggcaccauggucaccgucuccucc

SEQ ID NO: 16486 - RNA, 333 nt, Artificial Sequence
  derived and/or modified sequence opt2 from anti-HIV_CAP256-VRC26.UCA_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16487 - RNA, 432 nt, Artificial Sequence
  derived and/or modified sequence opt2 from anti-HIV_CAP256-VRC26.UCA_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucggcuaccccggccaggacccccgcggcgucgucggcgccuucgacaucuggggccagggcaccauggucaccgucuccucc

SEQ ID NO: 16488 - RNA, 324 nt, Artificial Sequence
  derived and/or modified sequence opt2 from anti-HIV_CH01_LightChain
gagaucguccucgcccagucccccggcacccucucccucucccccggcgagcgcgccacccucuccugccgcgccucccacaacguccaccccaaguacuucgccugguaccagcagaagcccggccaguccccccgccuccucaucuacggcggcuccacccgcgccgccggcauccccggcaaguucuccggcuccggcuccggcaccgacuucacccucaccaucucccgcgucgaccccgaggacuucgccgucuacuacugccagcaguacggcggcucccccuacaccuucggccagggcaccaaggucgagaucaag

SEQ ID NO: 16489 - RNA, 399 nt, Artificial Sequence
  derived and/or modified sequence opt2 from anti-HIV_CH01_HeavyChain
gagguccagcucgucgaguccggcgccaacgucguccgccccggcggcucccuccgccucuccugcaaggccuccggcuucaucuucgagaacuucggcuucuccuggguccgccaggcccccggcaagggccuccagugggucgccggccucaacuggaacggcggcgacacccgcuacgccgacuccgucaagggccgcuuccgcaugucccgcgacaacucccgcaacuucgucuaccucgacauggacaaggucggcgucgacgacaccgccuucuacuacugcgcccgcggcaccgacuacaccaucgacgacgccggcauccacuaccagggcuccggcaccuucugguacuucgaccucuggggccgcggcacccucgucuccgucuccucc

SEQ ID NO: 16490 - RNA, 324 nt, Artificial Sequence
  derived and/or modified sequence opt2 from anti-HIV_CH02_LightChain
gagaucguccucacccagucccccgccacccucuccgucucccccggcgagcgcgccacccucuccugccgcgccucccagaacguccacccccgcuacuucgccugguaccagcagaagcgcggccaguccccccgccuccucauccacuccggcuccacccgcgccgccggcaucgccgaccgcuucuccggcggcggcuccggcaugcacuucacccucaccaucacccgcgucgagcccgaggacuucgccgucuacuucugccagcaguacggcggcucccccuacaccuucggccagggcacccgcgucgagcuccgc

SEQ ID NO: 16491 - RNA, 399 nt, Artificial Sequence
  derived and/or modified sequence opt2 from anti-HIV_CH02_HeavyChain
gagguccagcucgucgaguccggcggcuccgucguccgccccggcggcucccuccgccucuccugccgcgccuccggcuucaucuucgagaacuacggccucaccuggguccgccagguccccggcaagggccuccacugggucuccggcaugaacuggaacggcggcgacacccgcuacgccgacuccguccgcggccgcuucuccaugucccgcgacaacuccaacaacaucgccuaccuccagaugaacaaccuccgcgucgaggacaccgcccucuacuacugcgcccgcggcaccgacuacaccaucgacgaccagggccgcuucuaccagggcuccggcaccuucugguacuucgacuucuggggccgcggcacccucgucaccgucuccucc

SEQ ID NO: 16492 - RNA, 324 nt, Artificial Sequence
  derived and/or modified sequence opt2 from anti-HIV_CH03_LightChain
gagaucguccucacccagucccccgccacccucucccucucccccggcgagcgcgccacccucuccugccgcgccucccaguccguccaccccaaguacuucgccugguaccagcagaagcccggccaguccccccgccuccucaucuacuccggcuccacccgcgccgccggcaucgccgaccgcuucuccggcggcggcuccggcauccacuucacccucaccaucacccgcgucgagcccgaggacuucgccgucuacuucugccagcaguacggcggcucccccuacaccuucggccagggcaccaaggucgagcuccgc

SEQ ID NO: 16493 - RNA, 399 nt, Artificial Sequence
  derived and/or modified sequence opt2 from anti-HIV_CH03_HeavyChain
gagguccagcucgucgaguccggcggcggcgucguccgccccggcggcucccuccgccucuccugcgccgccuccggcuucaucuucgagaacuacggccucaccuggguccgccagguccccggcaagggccuccacugggucuccggcaugaacuggaacggcggcgacacccgcuacgccgacuccguccgcggccgcuucuccaugucccgcgacaacuccaacaacaucgccuaccuccagaugaagaaccuccgcgucgacgacaccgcccucuacuacugcgcccgcggcaccgacuacaccaucgacgaccagggcaucuucuacaagggcuccggcaccuucugguacuucgaccucuggggccgcggcacccucgucaccgucuccucc

SEQ ID NO: 16494 - RNA, 324 nt, Artificial Sequence
  derived and/or modified sequence opt2 from anti-HIV_CH04_LightChain
gagaucguccucacccagucccccgacacccucucccucucccccggcgagcgcgccacccucuccugccgcgccucccaguccguccacucccgcuacuucgccugguaccagcacaagcccggccagcccccccgccuccucaucuacggcggcuccacccgcgccaccggcauccccaaccgcuucuccgccggcggcuccggcacccaguucacccucaccgucaaccgccucgaggccgaggacuucgccgucuacuacugccagcaguacggccgcucccccuacaccuucggccagggcaccaaggucgagauccgc

SEQ ID NO: 16495 - RNA, 399 nt, Artificial Sequence
  derived and/or modified sequence opt2 from anti-HIV_CH04_HeavyChain
gagguccagcucgucgaguccggcggcggccucauccgccccggcggcucccuccgccucuccugcaagggcuccggcuucaucuucgagaacuucggcuucggcuggguccgccagggccccggcaagggccucgagugggucuccggcaccaacuggaacggcggcgacucccgcuacggcgacuccgucaagggccgcuucaccaucucccgcgacaacuccaacaacuucgucuaccuccagaugaacucccuccgccccgaggacaccgccaucuacuacugcgcccgcggcaccgacuacaccaucgacgaccagggcauccgcuaccagggcuccggcaccuucugguacuucgacgucuggggccgcggcacccucgucaccgucuccucc

SEQ ID NO: 16496 - RNA, 627 nt, Artificial Sequence
  derived and/or modified sequence opt2 from anti-HIV_CH103_LightChain
uacgagcucacccagccccccuccgucuccgucucccccggccagaccgccaccaucaccugcuccggcgccuccaccaacgucugcugguaccaggucaagcccggccagucccccgaggucgucaucuucgagaacuacaagcgccccuccggcauccccgaccgcuucuccggcuccaaguccggcuccaccgccacccucaccauccgcggcacccaggccaucgacgaggccgacuacuacugccaggucugggacuccuucuccaccuucgucuucggcuccggcacccaggucaccguccuccgccagcccaaggccaaccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16497 - RNA, 678 nt, Artificial Sequence
  derived and/or modified sequence opt2 from anti-HIV_CH103_HeavyChain
cagguccagcuccaggaguccggccccggcgucgucaaguccuccgagacccucucccucaccugcaccgucuccggcggcuccaugggcggcaccuacugguccuggcuccgccucucccccggcaagggccucgaguggaucggcuacaucuuccacaccggcgagaccaacuacucccccucccucaagggccgcgucuccaucuccgucgacaccuccgaggaccaguucucccuccgccuccgcuccgucaccgccgccgacaccgccgucuacuucugcgccucccucccccgcggccagcucgucaacgccuacuuccgcaacuggggccgcggcucccucgucuccgucaccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaag

SEQ ID NO: 16498 - RNA, 321 nt, Artificial Sequence
  derived and/or modified sequence opt2 from anti-HIV_M66.6_LightChain
gacauccagcucacccagucccccuccucccucuccgccuccgucggcgaccgcgucaccaucaccugccgcgccucccaguccaucggcuccuaccucaacugguaccagcagaagcccggcaaggcccccaagcuccucaucuacgccgccuccacccuccaguccggcguccccucccgcuucuccggcuccggcuccggcaccgacuucacccucaccaucuccucccuccagcccgaggacuccgccaccuacuacugccagcaguccuacuccacccccuucaccuucggccccggcaccaaggucgacauccgc

SEQ ID NO: 16499 - RNA, 390 nt, Artificial Sequence
  derived and/or modified sequence opt2 from anti-HIV_M66.6_HeavyChain
cagguccagcucguccaguccggcgccgaggucaagaagcccggcgagucccucaagaucuccugcaaggucuccggcuacaacuucgccuccgaguggaucggcuggguccgccagaugcccggcaagggccucgaguggaugggcaucaucuaccccggcgacuccgacaccaaguacucccccuccuuccagggccaggucaucaucuccgccgacaaguccaucaacaccgccuaccuccagugguccucccucaaggccuccgacaccgccaucuacuacugcgcccgccagaaccacuacggcuccggcuccuacuucuaccgcaccgccuacuacuacgccauggacgucuggggccagggcaccaccgucaccgucuccucc

SEQ ID NO: 16500 - RNA, 327 nt, Artificial Sequence
  derived and/or modified sequence opt2 from anti-HIV_NIH45-46_LightChain
gagaucguccucacccagucccccgccacccucucccucucccccggcgagaccgccaucaucuccugccgcaccucccaguccggcucccucgccugguaccagcagcgccccggccaggccccccgccucgucaucuacuccggcuccacccgcgccgccggcauccccgaccgcuucuccggcucccgcuggggcgccgacuacaaccucuccaucuccaaccucgaguccggcgacuucggcgucuacuacugccagcaguacgaguucuucggccagggcaccaagguccaggucgacaucaagcgcaccgucgccgccccc

SEQ ID NO: 16501 - RNA, 399 nt, Artificial Sequence
  derived and/or modified sequence opt2 from anti-HIV_NIH45-46_HeavyChain
cagguccgccucucccaguccggcggccagaugaagaagcccggcgaguccaugcgccucuccugccgcgccuccggcuacgaguuccucaacugccccaucaacuggauccgccucgcccccggccgccgccccgaguggaugggcuggcucaagccccgcggcggcgccgucaacuacgcccgcaaguuccagggccgcgucaccaugacccgcgacgucuacuccgacaccgccuuccucgagcuccgcucccucaccuccgacgacaccgccgucuacuucugcacccgcggcaaguacugcaccgcccgcgacuacuacaacugggacuucgagcacuggggccgcggcgcccccgucaccgucuccuccgccuccaccaagggccccuccguc

SEQ ID NO: 16502 - RNA, 330 nt, Artificial Sequence
  derived and/or modified sequence opt2 from anti-HIV_PG16_LightChain
caguccgcccucacccagcccgccuccgucuccggcucccccggccagaccaucaccaucuccugcaacggcaccuccuccgacgucggcggcuucgacuccgucuccugguaccagcagucccccggcaaggcccccaaggucauggucuucgacgucucccaccgccccuccggcaucuccaaccgcuucuccggcuccaaguccggcaacaccgccucccucaccaucuccggccuccacaucgaggacgagggcgacuacuucugcuccucccucaccgaccgcucccaccgcaucuucggcggcggcaccaaggucaccguccuc

SEQ ID NO: 16503 - RNA, 411 nt, Artificial Sequence
  derived and/or modified sequence opt2 from anti-HIV_PG16_HeavyChain
caggagcagcucgucgaguccggcggcggcgucguccagcccggcggcucccuccgccucuccugccucgccuccggcuucaccuuccacaaguacggcaugcacuggguccgccaggcccccggcaagggccucgagugggucgcccucaucuccgacgacggcaugcgcaaguaccacuccgacuccauguggggccgcgucaccaucucccgcgacaacuccaagaacacccucuaccuccaguucuccucccucaaggucgaggacaccgccauguucuucugcgcccgcgaggccggcggccccaucuggcacgacgacgucaaguacuacgacuucaacgacggcuacuacaacuaccacuacauggacgucuggggcaagggcaccaccgucaccgucuccucc

SEQ ID NO: 16504 - RNA, 315 nt, Artificial Sequence
  derived and/or modified sequence opt2 from anti-HIV_PGT122_LightChain
accuucgucuccgucgcccccggccagaccgcccgcaucaccugcggcgaggagucccucggcucccgcuccgucaucugguaccagcagcgccccggccaggcccccucccucaucaucuacaacaacaacgaccgccccuccggcauccccgaccgcuucuccggcucccccggcuccaccuucggcaccaccgccacccucaccaucaccuccgucgaggccggcgacgaggccgacuacuacugccacaucugggacucccgccgccccaccaacugggucuucggcgagggcaccacccucaucguccuc

SEQ ID NO: 16505 - RNA, 396 nt, Artificial Sequence
  derived and/or modified sequence opt2 from anti-HIV_PGT122_HeavyChain
cagguccaccuccaggaguccggccccggccucgucaagcccuccgagacccucucccucaccugcaacgucuccggcacccucguccgcgacaacuacugguccuggauccgccagccccucggcaagcagcccgaguggaucggcuacguccacgacuccggcgacaccaacuacaaccccucccucaagucccgcguccaccucucccucgacaaguccaagaaccucgucucccuccgccucaccggcgucaccgccgccgacuccgccaucuacuacugcgccaccaccaagcacggccgccgcaucuacggcgucgucgccuucaaggagugguucaccuacuucuacauggacgucuggggcaagggcaccuccgucaccgucuccucc

SEQ ID NO: 16506 - RNA, 315 nt, Artificial Sequence
  derived and/or modified sequence opt2 from anti-HIV_PGT123_LightChain
uccuccauguccgucucccccggcgagaccgccaagaucuccugcggcaaggaguccaucggcucccgcgccguccagugguaccagcagaagcccggccagccccccucccucaucaucuacaacaaccaggaccgccccgccggcguccccgagcgcuucuccgccucccccgacuuccgccccggcaccaccgccacccucaccaucaccaacgucgacgccgaggacgaggccgacuacuacugccacaucuacgacgcccgcggcggcaccaacugggucuucgaccgcggcaccacccucaccguccuc

SEQ ID NO: 16507 - RNA, 396 nt, Artificial Sequence
  derived and/or modified sequence opt2 from anti-HIV_PGT123_HeavyChain
cagcuccaccuccaggaguccggccccggccucgucaagccccccgagacccucucccucaccugcuccgucuccggcgccuccaucaacgacgccuacugguccuggauccgccagucccccggcaagcgccccgagugggucggcuacguccaccacuccggcgacaccaacuacaaccccucccucaagcgccgcgucaccuucucccucgacaccgccaagaacgaggucucccucaagcucgucgaccucaccgccgccgacuccgccaccuacuucugcgcccgcgcccuccacggcaagcgcaucuacggcaucgucgcccucggcgagcucuucaccuacuucuacauggacgucuggggcaagggcaccgccgucaccgucuccucc

SEQ ID NO: 16508 - RNA, 315 nt, Artificial Sequence
  derived and/or modified sequence opt2 from anti-HIV_PGT125_LightChain
caguccgcccucacccagccccccuccgccuccggcucccccggccaguccaucaccaucuccugcaacggcaccgccaccaacuucgucuccugguaccagcaguuccccgacaaggcccccaagcucaucaucuucggcgucgacaagcgcccccccggcguccccgaccgcuucuccggcucccgcuccggcaccaccgccucccucaccgucucccgccuccagaccgacgacgaggccgucuacuacugcggcucccucgucggcaacugggacgucaucuucggcggcggcaccacccucaccguccuc

SEQ ID NO: 16509 - RNA, 411 nt, Artificial Sequence
  derived and/or modified sequence opt2 from anti-HIV_PGT125_HeavyChain
cagucccagcuccaggaguccggcccccgccucgucgaggccuccgagacccucucccucaccugcaacgucuccggcgaguccaccggcgccugcaccuacuucuggggcuggguccgccaggcccccggcaagggccucgaguggaucggcucccucucccacugccaguccuucuggggcuccggcuggaccuuccacaaccccucccucaagucccgccucaccaucucccucgacacccccaagaaccaggucuuccucaagcucaccucccucaccgccgccgacaccgccaccuacuacugcgcccgcuucgacggcgagguccucgucuacaaccacuggcccaagcccgccugggucgaccucuggggccgcggcauccccgucaccgucaccgucuccucc

SEQ ID NO: 16510 - RNA, 315 nt, Artificial Sequence
  derived and/or modified sequence opt2 from anti-HIV_PGT126_LightChain
caguccgcccucacccagccccccuccgccuccggcucccccggccaguccaucuccaucuccugcaccggcaccuccaaccgcuucgucuccugguaccagcagcaccccggcaaggcccccaagcucgucaucuacggcgucaacaagcgccccuccggcguccccgaccgcuucuccggcuccaaguccggcaacaccgccucccucaccgucuccggccuccagaccgacgacgaggccgucuacuacugcuccucccucgucggcaacugggacgucaucuucggcggcggcaccaagcucaccguccuc

SEQ ID NO: 16511 - RNA, 411 nt, Artificial Sequence
  derived and/or modified sequence opt2 from anti-HIV_PGT126_HeavyChain
cagccccagcuccaggaguccggccccggccucgucgaggccuccgagacccucucccucaccugcaccgucuccggcgacuccaccgccgccugcgacuacuucuggggcuggguccgccagccccccggcaagggccucgaguggaucggcggccucucccacugcgccggcuacuacaacaccggcuggaccuaccacaaccccucccucaagucccgccucaccaucucccucgacacccccaagaaccaggucuuccucaagcucaacuccgucaccgccgccgacaccgccaucuacuacugcgcccgcuucgacggcgagguccucgucuaccacgacuggcccaagcccgccugggucgaccucuggggccgcggcacccucgucaccgucaccgucuccucc

SEQ ID NO: 16512 - RNA, 315 nt, Artificial Sequence
  derived and/or modified sequence opt2 from anti-HIV_PGT127_LightChain
caguccgcccucacccagccccccuccgccuccggcucccccggccaguccaucaccaucuccugcaccggcaccuccaacaacuucgucuccugguaccagcaguaccccggcaaggcccccaagcucgucaucuacgaggucaacaagcgccccuccggcguccccgaccgcuucuccggcuccaaguccggcuccaccgccucccucaccgucuccggccuccaggccgacgacgagggcgucuacuacugcuccucccucgucggcaacugggacgucaucuucggcggcggcaccaagcucaccguccuc

SEQ ID NO: 16513 - RNA, 405 nt, Artificial Sequence
  derived and/or modified sequence opt2 from anti-HIV_PGT127_HeavyChain
cagccccagcuccaggaguccggccccggccucgucgaggccuccgagacccucucccucaccugcaccgucuccggcgacuccaccggccgcugcaacuacuucuggggcuggguccgccagccccccggcaagggccucgaguggaucggcucccucucccacugccgcuccuacuacaacaccgacuggaccuaccacaaccccucccucaagucccgccucaccaucucccucgacacccccaagaaccaggucuuccuccgccucaccuccgucaccgccgccgacaccgccaccuacuacugcgcccgcuucggcggcgagguccucgucuaccgcgacuggcccaagcccgccugggucgaccucuggggccgcggcacccucgucaccgucuccucc

SEQ ID NO: 16514 - RNA, 315 nt, Artificial Sequence
  derived and/or modified sequence opt2 from anti-HIV_PGT128_LightChain
caguccgcccucacccagccccccuccgccuccggcucccccggccaguccaucaccaucuccugcaccggcaccuccaacaacuucgucuccugguaccagcagcacgccggcaaggcccccaagcucgucaucuacgacgucaacaagcgccccuccggcguccccgaccgcuucuccggcuccaaguccggcaacaccgccucccucaccgucuccggccuccagaccgacgacgaggccgucuacuacugcggcucccucgucggcaacugggacgucaucuucggcggcggcaccaagcucaccguccuc

SEQ ID NO: 16515 - RNA, 405 nt, Artificial Sequence
  derived and/or modified sequence opt2 from anti-HIV_PGT128_HeavyChain
cagccccagcuccaggaguccggccccacccucgucgaggccuccgagacccucucccucaccugcgccgucuccggcgacuccaccgccgccugcaacuccuucuggggcuggguccgccagccccccggcaagggccucgagugggucggcucccucucccacugcgccuccuacuggaaccgcggcuggaccuaccacaaccccucccucaagucccgccucacccucgcccucgacacccccaagaaccucgucuuccucaagcucaacuccgucaccgccgccgacaccgccaccuacuacugcgcccgcuucggcggcgagguccuccgcuacaccgacuggcccaagcccgccugggucgaccucuggggccgcggcacccucgucaccgucuccucc

SEQ ID NO: 16516 - RNA, 330 nt, Artificial Sequence
  derived and/or modified sequence opt2 from anti-HIV_PGT130_LightChain
caguccgcccucacccagccccccuccgccuccggcucccucggccaguccgucaccaucuccugcaacggcaccuccuccgacaucggcggcuggaacuucgucuccugguaccagcaguuccccggccgcgccccccgccucaucaucuucgaggucaacaagcgccccuccggcguccccggccgcuucuccggcuccaaguccggcaacuccgccucccucaccgucuccggccuccaguccgacgacgagggccaguacuucugcuccucccucuucggccgcugggacgucgucuucggcggcggcaccaagcucaccguccuc

SEQ ID NO: 16517 - RNA, 387 nt, Artificial Sequence
  derived and/or modified sequence opt2 from anti-HIV_PGT130_HeavyChain
cagguccagcuccaggaguccggccccggccucgucaagcccgccgagacccucucccucaccugcuccgucuccggcgaguccaucaacaccggccacuacuacuggggcuggguccgccagguccccggcaagggccucgaguggaucggccacauccacuacaccaccgccguccuccacaaccccucccucaagucccgccucaccaucaagaucuacacccuccgcaaccagaucacccuccgccucuccaacgucaccgccgccgacaccgccgucuaccacugcguccgcuccggcggcgacauccucuacuacuacgaguggcagaagccccacugguucucccccuggggccccggcauccacgucaccgucuccucc

SEQ ID NO: 16518 - RNA, 330 nt, Artificial Sequence
  derived and/or modified sequence opt2 from anti-HIV_PGT131_LightChain
caguccgcccucacccagccccccuccgccuccggcucccucggccagucccucaccaucuccugcuccggcaccggcuccgacaucggcuccuggaacuucgucuccugguaccagcaguuccccggccgcgcccccaaccucaucaucuucgaggucaaccgccgccgcuccggcguccccgaccgcuucuccggcuccaaguccggcaacaccgccucccucaccgucuccggccuccgcuccgaggacgaggccgaguacuucugcuccucccucuccggccgcugggacaucgucuucggcggcggcaccaaggucaccguccuc

SEQ ID NO: 16519 - RNA, 387 nt, Artificial Sequence
  derived and/or modified sequence opt2 from anti-HIV_PGT131_HeavyChain
cagguccagcuccaggaguccggccccggccucgucaagcccuccgagacccucucccucaccugcaccgucuccggcgacuccaucaacaccggccaccacuacuggggcuggguccgccagguccccggcaagggccccgaguggaucgcccacauccacuacaacaccgccguccuccacaaccccgcccucaagucccgcgucaccaucuccaucuucacccucaagaaccucaucacccucucccucuccaacgucaccgccgccgacaccgccgucuacuucugcguccgcuccggcggcgacauccucuacuacaucgaguggcagaagccccacugguucuaccccuggggccccggcauccucgucaccgucuccucc

SEQ ID NO: 16520 - RNA, 321 nt, Artificial Sequence
  derived and/or modified sequence opt2 from anti-HIV_PGT135_LightChain
gagaucgucaugacccagucccccgacacccucuccgucucccccggcgagaccgucacccucuccugccgcgccucccagaacaucaacaagaaccucgccugguaccaguacaagcccggccaguccccccgccucgucaucuucgagaccuacuccaagaucgccgccuuccccgcccgcuucgucgccuccggcuccggcaccgaguucacccucaccaucaacaacaugcaguccgaggacgucgccgucuacuacugccagcaguacgaggaguggccccgcaccuucggccagggcaccaaggucgacaucaag

SEQ ID NO: 16521 - RNA, 399 nt, Artificial Sequence
  derived and/or modified sequence opt2 from anti-HIV_PGT135_HeavyChain
cagcuccagaugcaggaguccggccccggccucgucaagcccuccgagacccucucccucuccugcaccgucuccggcgacuccauccgcggcggcgaguggggcgacaaggacuaccacuggggcuggguccgccacuccgccggcaagggccucgaguggaucggcuccauccacuggcgcggcaccacccacuacaaggagucccuccgccgccgcgucuccauguccaucgacaccucccgcaacugguucucccuccgccucgccuccgucaccgccgccgacaccgccgucuacuucugcgcccgccaccgccaccacgacgucuucaugcucguccccaucgccggcugguucgacgucuggggccccggcguccaggucaccgucuccucc

SEQ ID NO: 16522 - RNA, 321 nt, Artificial Sequence
  derived and/or modified sequence opt2 from anti-HIV_PGT136_LightChain
gagaucgucaugacccaguccccccccacccucuccgucucccccggcgagaccgccacccucuccugccgcgccucccagaacgucaagaacaaccucgccugguaccagcucaagcccggccaggccccccgccuccucaucuucgacgccuccucccgcgccggcggcauccccgaccgcuucuccggcuccggcuacggcaccgacuucacccucaccgucaacuccguccaguccgaggacuucggcgacuacuucugccagcaguacgaggaguggccccgcaccuucggccagggcaccaaggucgacaucaag

SEQ ID NO: 16523 - RNA, 402 nt, Artificial Sequence
  derived and/or modified sequence opt2 from anti-HIV_PGT136_HeavyChain
cagcuccagcuccaggaguccggccccggccucgucaagcccuccgagacccucucccucaccugcaccgucuccggcggcuccaugcgcggcaccgacuggggcgagaacgacuuccacuacggcuggauccgccaguccuccgccaagggccucgaguggaucggcuccauccacuggcgcggccgcaccacccacuacaagaccuccuuccgcucccgcgccacccucuccaucgacaccuccaacaaccgcuucucccucaccuucuccuucgucaccgccgccgacaccgccgucuacuacugcgcccgccacaaguaccacgacaucuuccgcgucguccccgucgccggcugguucgaccccuggggccagggccuccucgucaccgucuccucc

SEQ ID NO: 16524 - RNA, 321 nt, Artificial Sequence
  derived and/or modified sequence opt2 from anti-HIV_PGT137_LightChain
gagaucaugaugacccagucccccgccauccucuccgucucccccggcgaccgcgccacccucuccugccgcgccucccaguccgucaagaacaaccucgccugguaccagaagcgccccggccaggccccccgccuccucaucuucgacaccuccucccgcgccuccggcauccccgcccgcuucuccggcggcggcuccggcaccgaguucacccucaccgucaacuccaugcaguccgaggacuucgccaccuacuacugccagcaguacgaggaguggccccgcaccuucggccagggcaccaaggucgagaucaag

SEQ ID NO: 16525 - RNA, 399 nt, Artificial Sequence
  derived and/or modified sequence opt2 from anti-HIV_PGT137_HeavyChain
gagguccaccucgaggaguccggccccggccucguccgccccuccgagacccucucccucaccugcaccgccuccggcggcuccauccgcggcggcgaguggggcgacuccgacuaccacuggggcuggguccgccacucccccgagaagggccucgaguggaucggcuccauccacuggcgcggcaccacccacuacaacgcccccuuccgcggccgcggccgccucuccaucgaccucucccgcaaccaguucucccuccgccucaccuccgucaccgccgaggacaccgccgucuacuacugcgucaagcacaaguaccacgacaucgucauggucguccccaucgccggcugguucgaccccuggggccagggccuccaggucaccgucuccucc

SEQ ID NO: 16526 - RNA, 336 nt, Artificial Sequence
  derived and/or modified sequence opt2 from anti-HIV_PGT141_LightChain
gacaccgucgucacccaguccccccucucccuccccgucacccccggcgaggccgccuccauguccugcuccuccacccagucccuccgccacuccaacggcgccaacuaccucgccugguaccagcacaagcccggccaguccccccgccuccucauccgccucggcucccagcgcgccuccggcguccccgaccgcuucuccggcuccggcuccggcacccacuucacccucaagaucucccgcgucgaggccgaggacgccgccaucuacuacugcaugcagggccucaaccgccccuggaccuucggcaagggcaccaagcucgagaucaag

SEQ ID NO: 16527 - RNA, 423 nt, Artificial Sequence
  derived and/or modified sequence opt2 from anti-HIV_PGT141_HeavyChain
cagguccagcucguccaguccggccccgaggucaagaagcccggcuccuccgucaaggucuccugcaaggccuccggcaacaccuucuccaaguacgacguccacuggguccgccaggccaccggccagggccucgagugggucggcuggaugucccacgagggcgacaagaccgaguccgcccagcgcuucaagggccgcgucaccuucacccgcgacaccuccgccuccaccgccuacauggagcuccgcggccucaccuccgacgacaccgccaucuacuacugcacccgcggcuccaagcaccgccuccgcgacuacguccucuacgacgacuacggccucaucaacuaccaggaguggaacgacuaccucgaguuccucgacgucuggggccacggcaccgccgucaccgucuccucc

SEQ ID NO: 16528 - RNA, 336 nt, Artificial Sequence; identical to SEQ ID NO: 16526
  derived and/or modified sequence opt2 from anti-HIV_PGT142_LightChain

SEQ ID NO: 16529 - RNA, 423 nt, Artificial Sequence
  derived and/or modified sequence opt2 from anti-HIV_PGT142_HeavyChain
cagguccagcucguccaguccggccccgaggucaagaagcccggcuccuccgucaaggucuccugcaaggccuccggcaacaccuucuccaaguacgacguccacuggguccgccaggccaccggccagggccucgagugggucggcuggaucucccacgagcgcgacaagaccgaguccgcccagcgcuucaagggccgcgucaccuucacccgcgacaccuccgccaccaccgccuacauggagcuccgcggccucaccuccgacgacaccgccaucuacuacugcacccgcggcuccaagcaccgccuccgcgacuacguccucuacgacgacuacggccucaucaacuaccaggaguggaacgacuaccucgaguuccucgacgucuggggccacggcaccgccgucaccgucuccucc

SEQ ID NO: 16530 - RNA, 336 nt, Artificial Sequence
  derived and/or modified sequence opt2 from anti-HIV_PGT143_LightChain
gacaccgucgucacccaguccccccucucccuccccgucacccccggcgaggccgccuccauguccugcaccuccacccagucccuccgccacuccaacggcgccaacuaccucgccugguaccagcacaagcccggccaguccccccgccuccucauccgccucggcucccagcgcgccuccggcguccccgaccgcuucuccggcuccggcuccggcacccacuucacccucaagaucucccgcgucgagcccgaggacgccgccaucuacuacugcaugcagggccucaaccgccccuggaccuucggcaagggcaccaagcucgagaucaag

SEQ ID NO: 16531 - RNA, 423 nt, Artificial Sequence
  derived and/or modified sequence opt2 from anti-HIV_PGT143_HeavyChain
cagguccagcucgagcaguccggcgccgaggucaagaagcccggcuccuccgucaaggucuccugcaaggccuccggcaacaccuucuccaaguacgacguccacuggguccgccaggccaccggccagggccucgagugggucggcuggaugucccacgagggcgacaagaccgaguccgcccagcgcuucaagggccgcgucaccuucacccgcgacaccuccgccuccaccgccuacauggagcuccgcggccucaccuccgacgacaccgccaucuacuacugcacccgcggcuccaagcaccgccuccgcgacuacguccucuacgacgacuacggccucaucaacuaccaggaguggaacgacuaccucgaguuccucgacgucuggggccacggcaccgccgucaccgucuccucc

SEQ ID NO: 16532 - RNA, 336 nt, Artificial Sequence
  derived and/or modified sequence opt2 from anti-HIV_PGT144_LightChain
gacaccgucgucacccaguccccccucucccucuccgucacccccggcgaggccgccuccauguccugcaccuccacccagucccuccgccacuccaacggcgccaacuaccucgccugguaccagcacaagcccggccaguccccccgccuccucauccgccucggcucccagcgcgccuccggcguccccgaccgcuucuccggcuccggcuccggcacccacuucacccucaagaucucccgcgucgaggccgacgacgccgccaucuacuacugcaugcagggccucaaccgccccuggaccuucggcaagggcaccaagcucgagaucaag

SEQ ID NO: 16533 - RNA, 423 nt, Artificial Sequence
  derived and/or modified sequence opt2 from anti-HIV_PGT144_HeavyChain
cagguccagcucguccaguccggcgccgaggucaagaagcccggcuccuccgucaaggucuccugcaaggccuccggcaacaccuuccgcaaguacgacguccacuggguccgccaggccaccggccagggccucgagugggucggcuggaugucccacgagggcgacaagaccgaguccgcccagcgcuucaagggccgcgucuccuucacccgcgacaacuccgccuccaccgccuacaucgagcuccgcggccucaccuccgacgacaccgccaucuacuacugcaccggcggcuccaagcaccgccuccgcgacuacguccucuacgacgacuacggccucaucaaccagcaggaguggaacgacuaccucgaguuccucgacgucuggggccacggcaccgccgucaccgucuccucc

SEQ ID NO: 16534 - RNA, 336 nt, Artificial Sequence
  derived and/or modified sequence opt2 from anti-HIV_PGT145_LightChain
gaggucgucaucacccaguccccccucuuccuccccgucacccccggcgaggccgccucccucuccugcaagugcucccacucccuccagcacuccaccggcgccaacuaccucgccugguaccuccagcgccccggccagaccccccgccuccucauccaccucgccacccaccgcgccuccggcguccccgaccgcuucuccggcuccggcuccggcaccgacuucacccucaagaucucccgcgucgaguccgacgacgucggcaccuacuacugcaugcagggccuccacucccccuggaccuucggccagggcaccaaggucgagaucaag

SEQ ID NO: 16535 - RNA, 420 nt, Artificial Sequence
  derived and/or modified sequence opt2 from anti-HIV_PGT145_HeavyChain
cagguccagcucguccaguccggcgccgaggucaagaagcccggcuccuccgucaaggucuccugcaaggccuccggcaacuccuucuccaaccacgacguccacuggguccgccaggccaccggccagggccucgaguggaugggcuggaugucccacgagggcgacaagaccggccucgcccagaaguuccagggccgcgucaccaucacccgcgacuccggcgccuccaccgucuacauggagcuccgcggccucaccgccgacgacaccgccaucuacuacugccucaccggcuccaagcaccgccuccgcgacuacuuccucuacaacgaguacggccccaacuacgaggaguggggcgacuaccucgccacccucgacgucuggggccacggcaccgccgucaccgucuccucc

SEQ ID NO: 16536 - RNA, 657 nt, Artificial Sequence
  derived and/or modified sequence opt2 from anti-HIV_PGT151_LightChain
gacaucgucaugacccagaccccccucucccucuccgucacccccggccagcccgccuccaucuccugcaaguccuccgagucccuccgccaguccaacggcaagaccucccucuacugguaccgccagaagcccggccaguccccccagcuccucgucuucgaggucuccaaccgcuucuccggcgucuccgaccgcuucgucggcuccggcuccggcaccgacuucacccuccgcaucucccgcgucgaggccgaggacgucggcuucuacuacugcaugcaguccaaggacuucccccucaccuucggcggcggcaccaaggucgaccucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16537 - RNA, 720 nt, Artificial Sequence
  derived and/or modified sequence opt2 from anti-HIV_PGT151_HeavyChain
cgcguccagcucgucgaguccggcggcggcgucguccagcccggcaaguccguccgccucuccugcgucgucuccgacuuccccuucuccaaguaccccauguacuggguccgccaggcccccggcaagggccucgagugggucgccgccaucuccggcgacgccuggcacgucgucuacuccaacuccguccagggccgcuuccucgucucccgcgacaacgucaagaacacccucuaccucgagaugaacucccucaagaucgaggacaccgccgucuaccgcugcgcccgcauguuccaggaguccggccccccccgccucgaccgcugguccggccgcaacuacuacuacuacuccggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaag

SEQ ID NO: 16538 - RNA, 657 nt, Artificial Sequence
  derived and/or modified sequence opt2 from anti-HIV_PGT152_LightChain
gacaucgucaugacccagaccccccucucccucuccgucgaccccggccagcccgccuccaucuccugcaaguccucccagucccuccgccaguccaacggcaagaccucccucuacugguaccagcagaagcccggccaguccccccagcuccucaucuucgaggucuccaaccgcuucuccggcgucuccgaccgcuucgucggcuccggcuccggcaccgacuucacccuccgcaucucccgcgucgaggccgaggacgucggcuucuacuacugcaugcaguccaaggacuucccccucaccuucggcggcggcaccaaggucgaccucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16539 - RNA, 720 nt, Artificial Sequence
  derived and/or modified sequence opt2 from anti-HIV_PGT152_HeavyChain
cgcguccagcucgucgaguccggcggcggcgucguccagcccggcaaguccguccgccucuccugcgucgucuccgacuuccccuucuccaaguaccccauguacuggguccgccaggcccccggcaagggccucgagugggucgccgccaucuccgccgacgccuggcacgucgucuacuccggcuccguccagggccgcuuccucgucucccgcgacaacuccaagaacauccucuaccucgagaugaacacccucaagaucgaggacaccgccgucuaccgcugcgcccgcauguuccaggaguccggccccccccgcuucgacuccugguccggccgcaacuacuacuacuacuccggcauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaag

SEQ ID NO: 16540 - RNA, 309 nt, Artificial Sequence
  derived and/or modified sequence opt2 from anti-HIV_VRC-CH30_LightChain
gacauccagaugacccagucccccuccucccucuccgccucccucggcgaccgcgucaccaucaccugccaggccucccgcggcaucggcaaggaccucaacugguaccagcagaagcccggcaaggcccccaagcuccucgucuccgacgccuccauccucgagggcggcguccccucccgcuucuccggcuccggcuuccaccagaacuucucccucaccaucuccucccuccagcccgaggacgucgccaccuacuucugccagcaguacgagaccuucggccagggcaccaaggucgacaucaag

SEQ ID NO: 16541 - RNA, 393 nt, Artificial Sequence
  derived and/or modified sequence opt2 from anti-HIV_VRC-CH30_HeavyChain
cagguccagcucguccaguccggcgccgccguccgcaagcccggcgccuccgucaccgucuccugcaaguucgccgaggacgacgacuacuccccccacugggucaaccccgcccccgagcacuacauccacuuccuccgccaggcccccggccagcagcucgaguggcucgccuggaugaaccccaccaacggcgccgucaacuacgccuggcagcuccacggccgccucaccgccacccgcgacggcuccaugaccaccgccuuccucgagguccgcucccuccgcuccgacgacaccgccgucuacuacugcgcccgcgcccagaagcgcggccgcuccgagugggccuacgcccacuggggccagggcacccccgucgccgucuccucc

SEQ ID NO: 16542 - RNA, 309 nt, Artificial Sequence
  derived and/or modified sequence opt2 from anti-HIV_VRC-CH31_LightChain
gacauccagaugacccagucccccuccucccucuccgccucccucggcgaccgcgucaccaucaccugccaggccucccgcggcaucggcaaggaccucaacugguaccagcagaaggccggcaaggcccccaagcuccucgucuccgacgccuccacccucgagggcggcguccccucccgcuucuccggcuccggcuuccaccagaacuucucccucaccaucuccucccuccaggccgaggacgucgccaccuacuucugccagcaguacgagaccuucggccagggcaccaaggucgacaucaag

SEQ ID NO: 16543 - RNA, 393 nt, Artificial Sequence
  derived and/or modified sequence opt2 from anti-HIV_VRC-CH31_HeavyChain
cagguccagcucguccaguccggcgccgccguccgcaagcccggcgccuccgucaccgucuccugcaaguucgccgaggacgacgacuacucccccuacugggucaaccccgcccccgagcacuucauccacuuccuccgccaggcccccggccagcagcucgaguggcucgccuggaugaaccccaccaacggcgccgucaacuacgccugguaccucaacggccgcgucaccgccacccgcgaccgcuccaugaccaccgccuuccucgaggucaagucccuccgcuccgacgacaccgccgucuacuacugcgcccgcgcccagaagcgcggccgcuccgagugggccuacgcccacuggggccagggcacccccgucgucgucuccucc

SEQ ID NO: 16544 - RNA, 309 nt, Artificial Sequence
  derived and/or modified sequence opt2 from anti-HIV_VRC-CH32_LightChain
gacauccagaugacccagucccccuccucccucuccgccucccucggcgaccgcgucaccaucaccugccaggccucccgcggcaucggcaaggaccucaacugguaccagcagaagcccggccgcgcccccaagcuccucgucuccgacgccuccauccucgagggcggcguccccacccgcuucuccggcuccggcuuccaccagaacuucucccucaccaucuccucccuccaggccgaggacgucgccaccuacuucugccagcaguacgagaccuucggccagggcaccaaggucgacaucaag

SEQ ID NO: 16545 - RNA, 393 nt, Artificial Sequence
  derived and/or modified sequence opt2 from anti-HIV_VRC-CH32_HeavyChain
cagguccagcucguccaguccggcgccgccguccgcaagcccggcgccuccgucaccgucuccugcaaguucgccgaggacgacgacuucuccccccacugggucaaccccgcccccgagcacuacauccacuuccuccgccaggcccccggccagcagcucgaguggcucgccuggaugaagcccaccaacggcgccgucaacuacgccuggcagcuccagggccgcgucaccgucacccgcgaccgcucccagaccaccgccuuccucgaggucaagaaccuccgcuccgacgacaccgccgucuacuacugcgcccgcgcccagaagcgcggccgcuccgagugggccuacgcccacuggggccagggcacccccgucgucaucuccgcc

SEQ ID NO: 16546 - RNA, 309 nt, Artificial Sequence
  derived and/or modified sequence opt2 from anti-HIV_VRC-CH33_LightChain
gacauccagaugacccagucccccuccucccucuccgccucccucggcgaccgcgucaccaucaccugccaggccucccgcggcaucggcaaggaccucaacugguaccagcagaagcgcggccgcgccccccgccuccucgucuccgacgccuccguccucgagggcggcguccccucccgcuucuccggcuccggcuuccaccagaacuucucccucaccaucuccacccuccagcccgaggacgucgccaccuacuucugccagcaguacgagaccuucggccagggcaccaaggucgacaucaag

SEQ ID NO: 16547 - RNA, 393 nt, Artificial Sequence
  derived and/or modified sequence opt2 from anti-HIV_VRC-CH33_HeavyChain
cagguccagcucguccaguccggcgccgccguccgcaagcccggcgccuccaucuccgucuccugcaaguucgccgacgccgacgacuacuccccccacuggaugaaccccgcccccgagcacuacauccacuuccuccgccaggcccccggccagcagcucgaguggcucgccuggaugaaccccaccaacggcgccgucaacuacgccugguaccucaacggccgcgucaccgccacccgcgaccgcuccaugaccaccgccuuccucgagguccgcucccuccgcuccgacgacaccgccgucuacuacugcgcccgcgcccagaagcgcgcccgcuccgagugggccuacgcccacuggggccagggcacccccgucgucgucuccucc

SEQ ID NO: 16548 - RNA, 309 nt, Artificial Sequence
  derived and/or modified sequence opt2 from anti-HIV_VRC-CH34_LightChain
gacauccagaugacccagucccccuccucccucuccgccucccucggcgaccgcgucaccaucaccugccaggccucccgcggcaucggcaaggaccucaacugguaccagcagaaggccggcaaggcccccaagcuccucgucuccgacgccuccauccucgagggcggcguccccucccgcuucuccggcuccggcuuccaccagaacuucucccucaccaucuccucccuccagcccgaggacgucgccaccuacuucugccagcaguacgagaccuucggccagggcaccaaggucgacaucaag

SEQ ID NO: 16549 - RNA, 393 nt, Artificial Sequence
  derived and/or modified sequence opt2 from anti-HIV_VRC-CH34_HeavyChain
cagguccagcucguccaguccggcgccgccguccgcaagcccggcgccuccgucaccgucuccugcaaguucgccgaggacgacgacugguccccccacugggucaaccccgcccccgagcacuacauccacuuccuccgccaggcccccggccagcagcucgaguggcucgccuggaugaaccccaccaacggcgccgucaacuacgccuggcagcucaacggccgccucaccgccacccgcgacaccuccaugaccaccgccuuccucgaggucaagucccuccgcuccgacgacaccgccgucuacuacugcgcccgcgcccagaagcgcggccgcuccgagugggccuacgcccacuggggccagggcacccccgucgucgucuccucc

SEQ ID NO: 16550 - RNA, 306 nt, Artificial Sequence
  derived and/or modified sequence opt2 from anti-HIV_VRC-PG04_LightChain
gagaucguccucacccagucccccggcacccucucccucucccccggcgagaccgccucccucuccugcaccgccgccuccuacggccacaugaccugguaccagaagaagcccggccagccccccaagcuccucaucuucgccaccuccaagcgcgccuccggcauccccgaccgcuucuccggcucccaguucggcaagcaguacacccucaccaucacccgcauggagcccgaggacuucgcccgcuacuacugccagcagcucgaguucuucggccagggcacccgccucgagauccgccgc

SEQ ID NO: 16551 - RNA, 375 nt, Artificial Sequence
  derived and/or modified sequence opt2 from anti-HIV_VRC-PG04_HeavyChain
cagguccagcucguccaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccgacuuccgccagcgcgucucccucacccgcgaccgcgaccucuucaccgcccacauggacauccgcggccucacccagggcgacaccgccaccuacuucugcgcccgccagaaguucuacaccggcggccagggcugguacuucgaccucuggggccgcggcacccucaucgucgucuccucc

SEQ ID NO: 16552 - RNA, 303 nt, Artificial Sequence
  derived and/or modified sequence opt2 from anti-HIV_VRC-PG04b_LightChain
gagaucguccucacccagucccccggcacccucucccucucccccggcgagaccgccucccucuccugcaccgccgccuccuacggccacaugaccugguaccagaagaagcccggccagccccccaagcuccucaucuucgccaccuccaagcgcgccuccggcauccccgaccgcuucuccggcucccaguucggcaagcaguacacccucaccaucacccgcauggagcccgaggacuucgccggcuacuacugccagcaggucgaguucuucggccagggcacccgccucgagauccgc

SEQ ID NO: 16553 - RNA, 375 nt, Artificial Sequence
  derived and/or modified sequence opt2 from anti-HIV_VRC-PG04b_HeavyChain
cagguccagcucguccaguccggcuccggcgucaagaagcccggcgccuccguccgcgucuccugcuggaccuccgaggacaucuucgagcgcaccgagcucauccacuggguccgccaggcccccggccagggccucgaguggaucggcugggucaagaccgucaccggcgccgucaacuucggcucccccaacuuccgccaccgcgucucccucacccgcgaccgcgaccucuucaccgcccacauggacauccgcggccucacccagggcgacaccgccaccuacuucugcgcccgccagaaguucgagcgcggcggccagggcugguacuucgaccucuggggccgcggcacccucaucgucgucuccucc

SEQ ID NO: 16554 - RNA, 612 nt, Artificial Sequence
  derived and/or modified sequence opt2 from anti-HIV_VRC-PG20_LightChain
caguccgcccucacccagccccccuccgucuccggcucccccggccaguccaucacccucuccugcaccggcgccuccaccuccgucgccugguaccagcaguacgccgacaaggccccccgccucaucgucuucgacggcaacaagcgccccuccgacaucuccucccgcuucuccggcucccaguccggcggcaccgccucccucaccaucuccggccuccaguccgaggacgaggccuacuaccacugcaacgccuucgaguucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccaccgagugc

SEQ ID NO: 16555 - RNA, 681 nt, Artificial Sequence
  derived and/or modified sequence opt2 from anti-HIV_VRC-PG20_HeavyChain
gagguccaccucaugcaguccggcaccgagaugaagaagcccggcgccuccguccgcgucaccugccagaccuccggcuacaccuucuccgacuacuucauccacuggcuccgccagguccccggccgcggcuucgaguggaugggcuggaugaacccccaguggggccaggucaacuacgcccgcaccuuccagggccgcgucaccaugacccgcgacgucuaccgcgaggucgccuaccucgaccuccgcucccucaccuucgccgacaccgccgucuacuucugcgcccgccgcaugcgcucccaggaccgcgagugggacuuccagcacuggggccagggcacccgcaucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaag

SEQ ID NO: 16556 - RNA, 1059 nt, Artificial Sequence
  derived and/or modified sequence opt2 from anti-HIV_VRC-PG20_G-Chain
gucuggaaggacgccgacaccacccucuucugcgccuccgacgccaaggcccacgagaccgagguccacaacgucugggccacccacgccugcguccccaccgaccccaacccccaggagauccaccucgagaacgucaccgagaacuucaacauguggaagaacaacauggucgagcagaugcaggaggacgucaucucccucugggaccagucccuccagcccugcgucaagcucaccggcggcuccgucaucaagcaggccugccccaagaucuccuucgaccccauccccauccacuacugcacccccgccggcuacgucauccucaagugcaacgacaagaacuucaacggcaccggccccugcaagaacgucuccuccguccagugcacccacggcaucaagcccgucgucuccacccagcuccuccucaacggcucccucgccgaggaggagaucaucauccgcuccgagaaccucaccaacaacgccaagaccaucaucguccaccucaacaaguccgucgagaucaacugcacccgccccuccaacggcggcuccggcuccggcggcgacauccgcaaggccuacugcgagaucaacggcaccaaguggaacaagguccucaagcaggucaccgagaagcucaaggagcacuucaacaacaagaccaucaucuuccagccccccuccggcggcgaccucgagaucaccaugcaccacuucaacugccgcggcgaguucuucuacugcaacaccacccagcucuucaacaacaccugcaucggcaacgagaccaugaagggcugcaacggcaccaucacccuccccugcaagaucaagcagaucaucaacauguggcagggcaccggccaggccauguacgccccccccaucgacggcaagaucaacugcgucuccaacaucaccggcauccuccucacccgcgacggcggcgccaacaacaccuccaacgagaccuuccgccccggcggcggcaacaucaaggacaacuggcgcuccgagcucuacaaguacaaggucguccagaucgag

SEQ ID NO: 16557 - RNA, 312 nt, Artificial Sequence
  derived and/or modified sequence opt2 from anti-HIV_VRC02_LightChain
gagaucguccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacaaccucaccauccgcaaccucgaguccggcgacuucggccucuacuacugccagcaguacgaguucuucggccagggcaccaagguccaggucgacaucaagcgc

SEQ ID NO: 16558 - RNA, 363 nt, Artificial Sequence
  derived and/or modified sequence opt2 from anti-HIV_VRC02_HeavyChain
cagguccagcucguccaguccggcggccagaugaagaagcccggcgaguccaugcgcaucuccugccaggccuccggcuacgaguucaucgacugcacccucaacuggguccgccucgcccccggccgccgccccgaguggaugggcuggcucaagccccgcggcggcgccgucaacuacgcccgcccccuccagggccgcgucaccaugacccgcgacgucuacuccgacaccgccuuccucgagcuccgcucccucaccgccgacgacaccgccgucuacuacugcacccgcggcaagaacugcgacuacaacugggacuucgagcacuggggccgcggcacccccgucaccgucuccucc

SEQ ID NO: 16559 - RNA, 309 nt, Artificial Sequence
  derived and/or modified sequence opt2 from anti-HIV_VRC03_LightChain
gagaucguccucacccagucccccggcauccucucccucucccccggcgagaccgccacccucuucugcaaggccucccagggcggcaacgccaugaccugguaccagaagcgccgcggccaggucccccgccuccucaucuacgacaccucccgccgcgccuccggcguccccgaccgcuucgucggcuccggcuccggcaccgacuucuuccucaccaucaacaagcucgaccgcgaggacuucgccgucuacuacugccagcaguucgaguucuucggccucggcuccgagcucgagguccaccgc

SEQ ID NO: 16560 - RNA, 390 nt, Artificial Sequence
  derived and/or modified sequence opt2 from anti-HIV_VRC03_HeavyChain
cagguccagcucguccaguccggcgccgucaucaagacccccggcuccuccgucaagaucuccugccgcgccuccggcuacaacuuccgcgacuacuccauccacuggguccgccucauccccgacaagggcuucgaguggaucggcuggaucaagccccucuggggcgccgucuccuacgcccgccagcuccagggccgcgucuccaugacccgccagcucucccaggaccccgacgaccccgacuggggcgucgccuacauggaguucuccggccucacccccgccgacaccgccgaguacuucugcguccgccgcggcuccugcgacuacugcggcgacuuccccuggcaguacuggggccagggcaccgucgucgucgucuccucc

SEQ ID NO: 16561 - RNA, 630 nt, Artificial Sequence
  derived and/or modified sequence opt2 from anti-HIV_VRC23_LightChain
gagaucgucaugacccagucccccgucaccgucuccgucucccgcggcggcaccgccacccucuccugccgcgccucccagggcgucggcuccgacgucgccugguaccagcacaagcccggccagaccccccgccuccucaucuacggcgccuccacccgcgccuccggcguccccgagcgcuucuccggcuccggcuuccacgucgacuucacccucuccaucuccggccuccagcccgaggacgucgccaucuacuacugccagcaguacgagaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16562 - RNA, 672 nt, Artificial Sequence
  derived and/or modified sequence opt2 from anti-HIV_VRC23_HeavyChain
gagguccaguucguccaguccggcgccgaggucaagaagcccggcgccuccguccgcgucuccugcgaggccuccggcuacuccuucaccgacuacguccuccaguggauccgccaggcccccggccagcgccccgaguggaugggcuggaucaagcccgagcgcggcgccgucuccuacgccccccaguuccagggccgccucacccucacccgcgaccucuacaccgagaccgccuacaugcacuucaagaaccuccgcuccgacgacaccgccaucuacuacugcgcccgcggcguccgccgcgacgccuccugguggcuccaguucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16563 - RNA, 1077 nt, Artificial Sequence
  derived and/or modified sequence opt2 from anti-HIV_VRC23_G-Chain
gucuggcgcgacgccgacaccacccucuucugcgccuccgacgccaaggccuacgagaccgagaagcacaacgucugggccacccacgccugcguccccaccgaccccaacccccaggagauccaccucgacaacgucaccgagaaguucaacauguggaagaacaacauggucgagcagaugcacaccgacaucaucucccucugggaccagucccucaagcccugcgucaagcucaccggcggcuccgccaucacccaggccugccccaaggucuccuucgagcccauccccauccacuacugcacccccgccggcuucgccauccucaagugcaaggacgagggcuucaacggcaccggccucugcaagaacgucuccaccguccagugcacccacggcaucaagcccgucgucuccacccagcuccuccucaacggcucccucgccgagaagaacaucaccauccgcuccgagaacaucaccaacaacgccaagaucaucaucguccagcucguccagcccgucaccaucaagugcauccgccccaacaacggcggcuccggcuccggcggcgacauccgccaggcccacugcaacgucacccgcucccgcuggaacaagacccuccaggaggucgccgagaagcuccgcaccuacuucggcaacaagaccaucaucuucgccaacuccuccggcggcgaccucgagaucaccacccacuccuucaacugcggcggcgaguucuucuacugcaacaccuccggccucuucaacuccaccugguacgucaacuccaccuggaacgacaccgacuccacccaggaguccaacgacaccaucacccuccccugccgcaucaagcagaucaucaacauguggcagcgcgccggccaggccauguacgccccccccauccccggcgucaucaagugcgaguccaacaucaccggccuccuccucacccgcgacggcggcaaggacaacaacgucaacgagaccuuccgccccggcggcggcgacaugcgcgacaacuggcgcuccgagcucuacaaguacaaggucgucgagaucgag

SEQ ID NO: 16564 - RNA, 648 nt, Artificial Sequence
  derived and/or modified sequence opt2 from anti-HIV_5CCK_LightChain
caguccgcccucacccagcccgccuccgucuccgccucccccggccaguccaucaccaucuccugcuccggcacccgcuccgacgucggcggcuacgacuucgucuccugguaccagcagcaccccggcaagguccccaagcucaucaucuacgaggucaccaagcgccccuccggcaucccccagcgcuucuccggcuccaaguccggcaacaccgccucccucaccaucuccggccuccaggccgacgacgaggccgacuacuacugcugcuccuacgccaacuacgacaagcucauccucggcggcggcaccaagcucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16565 - RNA, 696 nt, Artificial Sequence
  derived and/or modified sequence opt2 from anti-HIV_5CCK_HeavyChain
cagguccagcucguccaguccggcgccgagaugaaggaccccggcgccuccgucaaggucuccugccgcgccuccggcuacaaguucaccgacuacuacaugcacuggguccgccaggcccccggccagggccucgagugggucggcugggucaacaccaacggcggcuucaccaaguacggcgccaaguuccagggccgcgucaccgucacccgcgacaccuccaccaacaccgucuuccucgagcucucccgccucaccuucggcgacaccgccauguacuucugcgcccgccccaugcgccccgucucccacggcaucgacuacuccggccucuucgucuuccaguucuggggccgcggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgac

SEQ ID NO: 16566 - RNA, 648 nt, Artificial Sequence; identical to SEQ ID NO: 16442
  derived and/or modified sequence opt2 from anti-HIV_5AWN_LightChain

SEQ ID NO: 16567 - RNA, 696 nt, Artificial Sequence
  derived and/or modified sequence opt2 from anti-HIV_5AWN_HeavyChain
cagguccagcucaugcaguccggcgcccagcuccgcgaccccggcgacucccucaagaucuccugcaaggccuccggcuacaacuucaucgacuaccacauccacuggguccgccucgcccccggccgcggccucgaguggaugggcuggaucgaccccgucggcggcaucaccaaguacgccggccaguuccagggccgccucucccucacccgcgacaccuccaccaacacccucuuccucgagcucucccgccucaccgccggcgacaccgccgucuacuucugcgcccgcuccaugcgccccgucgaccacggcaucgacuacuccggccucuucgucuuccacuucuggggccgcggcuccgacguccucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgac

SEQ ID NO: 16568 - RNA, 645 nt, Artificial Sequence
  derived and/or modified sequence opt2 from anti-HIV_3QEG_LightChain
gagaucgucaugaugcagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccccgagaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16569 - RNA, 717 nt, Artificial Sequence
  derived and/or modified sequence opt2 from anti-HIV_3QEG_HeavyChain
cagguccagcucguccaguccggcgccgaggucaagaagcccggcuccuccgucaaggucuccugccgcgccucccgcggcaccuucuccuccuacggcaucaccuggguccgccaggcccccggccagggccucgaguggaugggcggcaucauccccaucuucgacgucaccaacuacgcccagaacuuccagggccgcgucgccaucaccaccgacgccgagauguccaccgccuacauggagcuccgcucccucaaguccgaggacuccgccgucuacuacugcgccuccgacucccgcgacuucuccuacuacgagcccggcaccuccuacucccacuacuacaacaucauggacgucuggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccac

SEQ ID NO: 16570 - RNA, 690 nt, Artificial Sequence
  derived and/or modified sequence opt2 from anti-HIV_1N0X_K-Chain
cagguccagcucguccaguccggcgccgaggucaagaagcccggcgccuccgucaaggucuccugccaggccuccggcuaccgcuucuccaacuucgucauccacuggguccgccaggcccccggccagcgcuucgaguggaugggcuggaucaaccccuacaacggcaacaaggaguucuccgccaaguuccaggaccgcgucaccuucaccgccgacaccuccgccaacaccgccuacauggagcuccgcucccuccgcuccgccgacaccgccgucuacuacugcgcccgcgucggccccuacuccugggacgacuccccccaggacaacuacuacauggacgucuggggcaagggcaccaccgucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16571 - RNA, 645 nt, Artificial Sequence
  derived and/or modified sequence opt2 from anti-HIV_1N0X_M-Chain
gagaucguccucacccagucccccggcacccucucccucucccccggcgagcgcgccaccuucuccugccgcuccucccacuccauccgcucccgccgcgucgccugguaccagcacaagcccggccaggccccccgccucgucauccacggcgucuccaaccgcgccuccggcaucuccgaccgcuucuccggcuccggcuccggcaccgacuucacccucaccaucacccgcgucgagcccgaggacuucgcccucuacuacugccaggucuacggcgccuccuccuacaccuucggccagggcaccaagcucgagcgcaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccuccgcucccccgucaccaaguccuucaaccgcggcgagugc

SEQ ID NO: 16572 - RNA, 654 nt, Artificial Sequence
  derived and/or modified sequence opt2 from anti-HIV_3QEH_HeavyChain
gacaucgucaugacccaguccccccucucccuccccgucacccccggcgaggccgccuccaucuccugccgcuccucccagucccuccuccacaccaacggcuuccaguaccucgacugguaccuccagaagcccggccaguccccccagcuccucaucuaccucggcuccaaccgcgccaccggcgucccccaccgcuucuccggcuccggcuccggcaccgaguucacccucaagaucucccgcgucgaggccgaggacgucggcgucuacuacugcaugcaggccaaggagucccccaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16573 - RNA, 696 nt, Artificial Sequence
  derived and/or modified sequence opt2 from anti-HIV_3QEH_G-Chain
cagguccagcucguccaguccggcgccgagguccgcaagcccggcgccuccgucaccgucuccugcaagaccuccggcuacaccuucgucaacuucuacaucgucuggguccgccaggcccccggccagggccucgaguggaugggcgucaucaaccccuuccgcggcgacaccuacuucgcccagaaguucaagggccgcgucacccucacccgcgacaccuccaccuccaccgucuucauggagcucuccucccuccgcuccgacgacaccgccaucuacuacugcgcccgcgaccucgagaugcgcgacggcaacaaccacggcucccaccucgaguucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccac

SEQ ID NO: 16574 - RNA, 678 nt, Artificial Sequence
  derived and/or modified sequence opt2 from anti-HIV_2B1H_HeavyChain
gagauccagcucgagcaguccggcgccgaggucaagaaguccggcgagucccucaagaucuccugccagaccuccggcuacuccuucuccgacuacuggaucggcuggguccgccagaugcccggcaagggccucgaguggaugggcaucuucuaccccggcgacuccgacucccgcuacucccccuccuucgagggccaggucaccauguccgccgaccgcuccaccaacaccgcccaccuccagugguccucccucaagcccuccgacaccgcccucuacuacugcgcccgccucggcggcgacuacgaggacuccggcgccgacgccuucgacuucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaagucc

SEQ ID NO: 16575 - RNA, 645 nt, Artificial Sequence
  derived and/or modified sequence opt2 from anti-HIV_2B1H_LightChain
caguccguccucacccagccccccuccgccuccggcacccccggccagcgcaucuccaucuccugcuccggcaccuccuccaacgucgagaacaacuacgucuacugguaccagcaccuccccggcaccgcccccaagcuccucaucuaccgcaacgaccaccgcuccuccggcauccccgaccgcuucuccgccuccaaguccggcaccuccgccucccucgccaucuccggccuccgccccgaggacgagggcgacuacuacugcgccgccugggacgacucccgcggcggccccgacugggucuucggcggcggcaccaagcucaccguccucgcccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccacc

SEQ ID NO: 16576 - RNA, 648 nt, Artificial Sequence
  derived and/or modified sequence opt2 from anti-HIV_3TNM_B-Chain
caguccguccucacccagccccccuccgccuccggcucccccggccaguccgucaccaucuccugcaccggcaccuccuccgacgucggcggcuacaacuacgucuccugguaccagcaccaccccggcaaggcccccaagcucaucaucuccgaggucaacaaccgccccuccggcguccccgaccgcuucuccggcuccaaguccggcaacaccgccucccucaccgucuccggccuccaggccgaggacgaggccgaguacuacugcuccuccuacaccgacauccacaacuucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 16577 - RNA, 693 nt, Artificial Sequence
  derived and/or modified sequence opt2 from anti-HIV_3TNM_A-Chain
cagguccagcuccaggaguccggccccggccucgucaagcccucccagacccucucccucuccugcaccgucuccggcggcuccuccuccuccggcgcccacuacugguccuggauccgccaguaccccggcaagggccucgaguggaucggcuacauccacuacuccggcaacaccuacuacaaccccucccucaagucccgcaucaccaucucccagcacaccuccgagaaccaguucucccucaagcucaacuccgucaccgucgccgacaccgccgucuacuacugcgcccgcggcacccgccuccgcacccuccgcaacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacacc

SEQ ID NO: 16578 - RNA, 690 nt, Artificial Sequence
  derived and/or modified sequence opt2 from anti-HIV_3UJJ_HeavyChain
gagguccagcucguccaguccggcgccgaggucaagaagcccggcgagucccucaagaucuccugcaaggccuccggcuacuccuucuccuccuacuggaucgccuggguccgccagaugcccggcaagggccucgaguggaugggcuucaucuaccccgccgacuccgacacccgcuacucccccuccuuccagggccagggcaccaucuccgccgacaaguccaucuccaccgccuaccuccagugguccucccucaaggccuccgacaccgccauguacuacugcgccauccucggcuucuggggcgccaaccgcggcggcggcggcauggacgucuggggccagggcaccaccgucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacc

SEQ ID NO: 16579 - RNA, 639 nt, Artificial Sequence
  derived and/or modified sequence opt2 from anti-HIV_3UJJ_LightChain
uccuacgagcucacccagccccccuccgucuccgucucccccggccagaccgcccgcaucaccugcuccggcgacgcccuccccgagaaguacgccuacugguaccagcagaaguccggccaggcccccguccucaucaucuacgaggacuccaagcgccccuccggcauccccgagcgcuucuccggcucccgcuccggcaccauggccacccucaccaucuccggcgcccaggucgacgacgaggccgacuacuacugcuacuccaccaacuccggcggcaccuucuucgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugc

SEQ ID NO: 16580 - RNA, 669 nt, Artificial Sequence
  derived and/or modified sequence opt2 from anti-HIV_3UJI_HeavyChain
cagguccagcucguccaguccgccgccgaggucaagaagcccggcgaggcccucaagaucuccugcaagggcuccggcuacuccuucuccaacuacuggaucgccuggguccgccagaugcccggcaagggccucgaguggaugggcaucgucuaccccgacgacuccgacuccuccuacaacuccuccuuccagggccagaucaccuucuccgccgacaaguccaucuccaccgccuaccuccacuggaccucccuccaggccuccgacaccgccauguacuacugcgcccgccucggcuucgagggcgacuacuccggcuccuucuucgacuacuggggccagggcacccuccucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccc

SEQ ID NO: 16581 - RNA, 627 nt, Artificial Sequence
  derived and/or modified sequence opt2 from anti-HIV_3UJI_LightChain
uccuacgagcucacccagccccccuccgucuccgucucccccggccagaccgccuccaucaccugcuccggcgacauccucggcgacaaguacgucuccugguaccagcagaaguccggccaguccccccuccucgucaucuacgaggacaccaagcgccccuccggcauccccgaccgcuucuccggcuccaaguccggcaacaccgccacccucaccaucuccggcacccaggccauggacgaggccgacuacuacugccaggccugggacuccacccucggcgucgucuucggcggcggcaccaaggucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgccccc

SEQ ID NO: 16582 - RNA, 666 nt, Artificial Sequence
  derived and/or modified sequence opt2 from anti-HIV_2QSC_HeavyChain
cagguccagcucguccaguccggcggcggccucguccagcccggcggcucccuccgccucuccugcgccgccuucggcuucaacuucuccuccuacgucaugcacuggguccgccaggcccccggccagggccucgaguaccucuccgccaucuccuccgacggcgagaccaccuaccacgccaacuccgucaagggccgcuucaccuccucccgcgacaacuccaagaacacccucuuccuccagaugggcucccuccgcaccgaggacgucgccgucuacuacugcgcccgcgaccgcuacuacgagaccuccggcuccaacgccuucgacgucuggggccagggcaccauggucgucgucuccuccgccuccaccaagggccccuccgucuucccccucgcccccugcucccgcuccaccuccgaguccaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccaacuucggcacccagaccuacaccugcaacgucgaccacaagcccuccaacaccaaggucgacaagaccgucgag

SEQ ID NO: 16583 - RNA, 645 nt, Artificial Sequence
  derived and/or modified sequence opt2 from anti-HIV_2QSC_LightChain
aacuccguccucacccagucccccuccucccucuccgccuccgucggcgaccgcgucaccaucaccugccaggccucccaggacaucuccaacuaccucaacugguaccagcacaagcccggcaaggcccccaagcuccucaucuacaccgccuccaaccucgagaccggcguccccucccgcuucuccggcggcggcuccggcacccacuucuccuucaccaucaccucccuccagcccgaggacgccgccaccuacuucugccagcaguacgacaaccucggcgaccucuccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16584 - RNA, 690 nt, Artificial Sequence
  derived and/or modified sequence opt2 from anti-HIV_3MLZ_HeavyChain
cagguccagcuccaggaguccggccccggccucgucaagcccuccgagacccucucccucaccugcaccgucuccggcggcuccaucuccggcuuccacugguccuggauccgccagccccccggcaagggccucgaguacaucggcuacaucuacuacuccggcuccaccuccuacaaccccucccucaagucccgcgucuccauguccgucgacaccucccgcaaccaguucucccucgagcucuccuccgucaccgccgccgacaccgccgucuacuacugcgcccgcgacuucggcgaguaccacuacgacggccgcggcuuccagugcgagggcuucgaccucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16585 - RNA, 642 nt, Artificial Sequence
  derived and/or modified sequence opt2 from anti-HIV_3MLZ_LightChain
caguccguccucacccagccccccuccgucuccgccgcccccggccagaaggucaccaucuccugcuccggcuccuccuccaacaucggcaacaacauggucuccugguaccagcagcaccccggcaccgcccccaagcuccucaucuacgagaacuccaagcgccccuccggcauccccgaccgcuucuccggcucccgcuccggcaccuccgccacccucggcaucaucggccuccagaccggcgacgaggccgaguacuacugcgccaccugggacggcucccuccgcaccgucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccguccgcgccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugc

SEQ ID NO: 16586 - RNA, 684 nt, Artificial Sequence
  derived and/or modified sequence opt2 from anti-HIV_3MLX_I-Chain
cagguccagcuccaggaguccggccccggccucgucaagcccuccgagacccucucccucaccugcaccgucuccggcggcuccaucuccggcuuccacugguccuggauccgccagccccccggcaagggccucgaguacaucggcuacaucuacuacuccggcuccaccuccuacaaccccucccucaagucccgcgucuccauguccgucgacaccucccgcaaccaguucucccucgagcucuccuccgucaccgccgccgacaccgccgucuacuacugcgcccgcgacuucggcgaguaccacuacgacggccgcggcuuccagugcgagggcuucgaccucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 16587 - RNA, 633 nt, Artificial Sequence
  derived and/or modified sequence opt2 from anti-HIV_3MLX_M-Chain
uccguccucacccagccccccuccgucuccgccgcccccggccagaaggucaccaucuccugcuccggcuccuccuccaacaucggcaacaacauggucuccugguaccagcagcaccccggcaccgcccccaagcuccucaucuacgagaacuccaagcgccccuccggcauccccgaccgcuucuccggcucccgcuccggcaccuccgccacccucggcaucaucggccuccagaccggcgacgaggccgaguacuacugcgccaccugggacggcucccuccgcaccgucuucggcggcggcaccaagcucaccguccucucccagcccaaggccgcccccuccgucacccucuucccccccuccuccgaggagcuccaggccaacaaggccacccucgucugccucaucuccgacuucuaccccggcgccgucaccgucgccuggaaggccgacuccucccccguccgcgccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccacc

SEQ ID NO: 16588 - RNA, 684 nt, Artificial Sequence
  derived and/or modified sequence opt2 from anti-HIV_3MLW_I-Chain
cagguccagcucguccaguccggcgccgaggucaagaaggccggcgagucccucgagaucuccugcaagggcuccggcuacaccuucaccgaccacuggaucgccuggguccgccagguccccggcaagggccucgaguggaugggcaugaucuaccccggcgacuccgacacccgcuacucccccucccuccagggccgcgucaccauguccgccgacaagacccucuccaccgccuaccuccaguggucccgccucgaggccuccgacaccgccauguacuacugcgcccgccuccacuacuccgaccgcuccggcuccuacuucaacgacgucuuccacauguggggccagggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaagucc

SEQ ID NO: 16589 - RNA, 645 nt, Artificial Sequence
  derived and/or modified sequence opt2 from anti-HIV_3MLW_M-Chain
caguccguccucacccagccccccuccgccuccggcacccccggccagcgcgucaccaucuccugcuccggcaacuccuccaacaucgagaacaacuacgucuacugguaccagcagcuccccggcuccacccccaagcuccucaucuuccgcgacgaccagcgccccuccggcguccccgaccgcuucuccggcuccaaguccggcaccuccgccucccucgccaucuccggccuccgcuccgaggacgaggccgacuacuacugcgccuccugggacgacucccgcggcggccccgacuacgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccacc

SEQ ID NO: 16590 - RNA, 678 nt, Artificial Sequence
  derived and/or modified sequence opt2 from anti-HIV_3MLV_N-Chain
gagguccagcucgucgaguccggcggcgaggucaagcagcccggccagucccucaagaucuccugcaaguccuccggcuacaacuuccucgacuccuggaucggcuggguccgccagauccccggcaagggccucgaguggaucggcaucaucuaccccgacgacuccgacgcccacuacucccccuccuucgagggccaggucaccauguccgucgacaaguccaucuccaccgccuaccuccaguggaccacccuccaggccuccgacaccggcaaguacuucugcacccgccucuaccucuucgagggcgcccaguccuccaacgccuucgaccucuggggccagggcaccaugauccucgucuccuccggcaccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaagucc

SEQ ID NO: 16591 - RNA, 657 nt, Artificial Sequence
  derived and/or modified sequence opt2 from anti-HIV_3MLV_M-Chain
uccuaccuccucacccagccccccuccgucuccgucucccccggccagaccgccuccaucuccugcuccggcgacaagcucgacgacaaguacgucuccugguacuaccagcgccccggccagucccccguccuccucauguaccaggacuucaagcgccccuccggcauccccgagcgccucuccggcuccaaguccggcaagaccgccacccucaccaucuccggcacccagucccucgacgagggcgacuacuacugccaggccugggacgccuccaccggcgucuccggcggcggcaccaagcucaccguccucuucggcgagggcacccgccucaccguccucgcccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccacc

SEQ ID NO: 16592 - RNA, 654 nt, Artificial Sequence
  derived and/or modified sequence opt2 from anti-HIV_3MLU_LightChain
uaccuccucacccagccccccuccgucuccgucucccccggccagaccgccuccaucuccugcuccggcgacaagcucgacgacaaguacgucuccugguacuaccagcgccccggccagucccccguccuccucauguaccaggacuucaagcgccccuccggcauccccgagcgccucuccggcuccaaguccggcaagaccgccacccucaccaucuccggcacccagucccucgacgagggcgacuacuacugccaggccugggacgccuccaccggcgucuccggcggcggcaccaagcucaccguccucuucggcgagggcacccgccucaccguccucgcccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccacc

SEQ ID NO: 16593 - RNA, 657 nt, Artificial Sequence
  derived and/or modified sequence opt2 from anti-HIV_3MLT_G-Chain
uccuacgaccucacccagccccccuccgucuccgucucccccggccagaccgccuccaucuccugcuccggcgacaagcucgacgacaaguacgucuccugguacuaccagcgccccggccagucccccguccuccucauguaccaggacuucaagcgccccuccggcauccccgagcgccucuccggcuccaaguccggcaagaccgccacccucaccaucuccggcacccagucccucgacgagggcgacuacuacugccaggccugggacgccuccaccggcgucuccggcggcggcaccaagcucaccguccucuucggcgacggcacccgccucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccacaaguccuacuccugccaggucacccacgagggcuccaccgucgagaagaccgucgcccccacc

SEQ ID NO: 16594 - RNA, 666 nt, Artificial Sequence
  derived and/or modified sequence opt2 from anti-HIV_3GO1_HeavyChain
gagguccagcuccaggaguccggccccggccucgucaagcccuccgagacccucucccucaccugcaccgucuccggcggccccaucaacaacgccuacuggaccuggauccgccagccccccggcaagggccucgaguaccucggcuacgucuaccacaccggcgucaccaacuacaaccccucccucaagucccgccucaccaucaccaucgacaccucccgcaagcagcucucccucucccucaaguucgucaccgccgccgacuccgccgucuacuacugcgcccgcgagugggccgaggacggcgacuucggcaacgccuuccacgucuggggccagggcaccauggucgccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagccc

SEQ ID NO: 16595 - RNA, 627 nt, Artificial Sequence
  derived and/or modified sequence opt2 from anti-HIV_3GO1_LightChain
uccuacguccucacccagccccccuccgucuccgucucccccggccagaccgcccgcaucaccugcuccgccgaggcccucuccaaccaguacgccuacugguaccgccagcgccccggccaggccccccuccucaucaucuacaaggacaccaagcgccccuccggcauccccgagcgcuucuccggcuccaccuccggcaccaccgucacccucaccaucuccggcguccaggccgaggacgaggccgacuacuacugccaguccgccgacuccuccggcgacuacgucuucggcggcggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgccccc

SEQ ID NO: 16596 - RNA, 690 nt, Artificial Sequence
  derived and/or modified sequence opt2 from anti-HIV_4XCY_J-Chain
cagguccagcucguccaguccggcgccgaggucaagcgccccggcuccuccgucaccgucuccugcaaggccuccggcggcuccuucuccaccuacgcccucuccuggguccgccaggcccccggccgcggccucgaguggaugggcggcgucaucccccuccucaccaucaccaacuacgccccccgcuuccagggccgcaucaccaucaccgccgaccgcuccaccuccaccgccuaccucgagcucaacucccuccgccccgaggacaccgccgucuacuacugcgcccgcgagggcaccaccggcuggggcuggcucggcaagcccaucggcgccuucgcccacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugc

SEQ ID NO: 16597 - RNA, 645 nt, Artificial Sequence
  derived and/or modified sequence opt2 from anti-HIV_4XCY_K-Chain
gagaucguccucacccagucccccggcacccagucccucucccccggcgagcgcgccacccucuccugccgcgccucccaguccgucggcaacaacaagcucgccugguaccagcagcgccccggccaggccccccgccuccucaucuacggcgccuccucccgccccuccggcgucgccgaccgcuucuccggcuccggcuccggcaccgacuucacccucaccaucucccgccucgagcccgaggacuucgccgucuacuacugccagcaguacggccagucccucuccaccuucggccagggcaccaaggucgaggucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 16598 - RNA, 630 nt, Artificial Sequence
  derived and/or modified sequence opt2 from anti-HIV_4YBL_C-Chain
guccucacccagccccccuccgccuccggcucccccggccaguccgucaccaucuccugcaccggcaccuccuccgacgucggcggcuacaacuacgucuccugguaccagcaccaccccggcaaggcccccaagcucaucaucuccgaggucaacaaccgccccuccggcguccccgaccgcuucuccggcuccaaguccggcaacaccgccucccucaccgucuccggccuccaggccgaggacgaggccgaguacuacugcuccuccuacaccgacauccacaacuucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgccccc

SEQ ID NO: 16599 - RNA, 672 nt, Artificial Sequence
  derived and/or modified sequence opt2 from anti-HIV_4YBL_B-Chain
cagguccagcuccaggaguccggccccggccucgucaagcccucccagacccucucccucuccugcaccgucuccggcggcuccuccuccuccggcgcccacuacugguccuggauccgccaguaccccggcaagggccucgaguggaucggcuacauccacuacuccggcaacaccuacuacaaccccucccucaagucccgcaucaccaucucccagcacaccuccgagaaccaguucucccucaagcucaacuccgucaccgucgccgacaccgccgucuacuacugcgcccgcggcacccgccuccgcacccuccgcaacgccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaag

SEQ ID NO: 16600 - RNA, 630 nt, Artificial Sequence
  derived and/or modified sequence opt2 from anti-HIV_4R4N_X-Chain
gacauccagaugacccagucccccuccuucgucuccgccuccgucggcgaccgcgucaccaucaccugccgcgccucccagggcaucuccuccuaccucgccugguaccagcagaagcccggcaaggcccccaagcucgucaucuacgccgccuccacccuccaguccggcguccccucccgcuucuccggcuccggcuccggcaccgaguucacccucaccaucuccucccuccagcccgaggacuucgccaccuacuacugccagcaccucaucggccuccgcuccuucggccagggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgc

SEQ ID NO: 16601 - RNA, 660 nt, Artificial Sequence
  derived and/or modified sequence opt2 from anti-HIV_4R4B_F-Chain
cagguccagcuccagcaguggggcgccggccuccucaagcccuccgagacccucucccucaccugcggcgucuacggcgagucccucuccggccacuacugguccuggguccgccagccccccggcaagcgccucgaguggaucggcgagaucaagcacaacggcucccccaacuaccaccccucccucaagucccgcgucaccaucucccucgacauguccaagaaccaguucucccucaaccucaccuccgucaccgccgccgacaccgccgucuacuucugcgcccgccgcuccaacuggcccuaccuccccuucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaag

SEQ ID NO: 16602 - RNA, 750 nt, Artificial Sequence
  derived and/or modified sequence opt2 from anti-HIV_3JUY_D-Chain
cagguccagcucguccaguccggcgccgaggucaagaagcccggcgccuccgucaaggucuccugccaggccuccggcuaccgcuucucccacuucaccguccacuggguccgccaggcccccggccagcgcuucgaguggaugggcuggaucaaccccuacaacggcaacaaggaguucuccgccaaguuccaggaccgcgucaccuucaccgccgacaccuccgccaacaccgccuacauggagcuccgcucccuccgcuccgccgacaccgccgucuacuacugcgcccgcgucggcgaguggggcugggacgacucccccuacgacaacuacuacauggacgucuggggcaagggcaccaccgucaucgucuccuccggcggcggcggcuccggcggcggcggcuccggcggcggcggcuccgagaucguccucacccaggcccccggcacccucucccucucccccggcgagcgcgccaccuucuccugccgcuccucccacuccauccgcucccgccgcgucgccugguaccagcacaagcccggccaggccccccgccucgucauccacggcgucuccaaccgcgccuccggcaucuccgaccgcuucuccggcuccggcuccggcaccgacuucacccucaccaucacccgcgucgagcccgaggacuucgcccucuacuacugccaggucuacggcgccuccuccuacaccuucggccagggcaccaagcucgagcgcaag

SEQ ID NO: 16603 - RNA, 369 nt, Artificial Sequence
  derived and/or modified sequence opt2 from anti-HIV_4KG5_HeavyChain
cagcucguccaguccggccccgaggccaagcgccccggcuccuccgucaaggucuccugcaaggccucccgcgacaccuucaacaacuacguccucaacuggguccgccaggcccccggccagggccucgaguggaugggcggcaucggccccaucaucgagaccgccgacuacgccgagaaguuccgcggccgccucuccaucaccgccgacgaguccaccaccaccgccuacauggagcucuccucccucaccuccgacgacaccgccgucuacuacugcgcccgcucccccuacuccucccucaccgacaccuacuacuacuacauggaccucuggggcaagggcaccaccgucaccgucuccucc

SEQ ID NO: 16604 - RNA, 336 nt, Artificial Sequence
  derived and/or modified sequence opt2 from anti-HIV_4KG5_LightChain
cucacccagucccccgacucccucgccgucucccucggcgagcgcgccaccaucaacugcaaguccucccaguccauccucgacuccuccaacaaccgcaacuaccucaccugguaccagcagaagcccggccagccccccaagcuccucaucuacugggccuccacccgcgaguccggcguccccgaccgcuucuccggcuccggcuccuccaccgacuucacccucaccaucuccucccuccaggccgaggacgucgccgucuacuacugccagcaguacuucuccacccccggcaucaccuucggccagggcacccgccucgagaucaagcgc

SEQ ID NO: 16605 - RNA, 309 nt, Artificial Sequence
  derived and/or modified sequence opt2 from anti-HIV-1_LightChain
gagaucguccucacccagucccccgccacccucucccucucccccggcgagcgcgccacccucuccugccgcgccucccaguccgucuacaccaagcucgccugguaccagcagaagcccggccagcccccccgccuccucaucuacgacgccuccaaccgcgccgccggcauccccgcccgcuucuccggcuccggcuccggcaccgaguucacccucaccaucaagcgcauggagcgcgaggacuucgccgucuacuacugccagauccucgaguucuucggccagggcaccaccaucgacaugaac

SEQ ID NO: 16606 - RNA, 312 nt, Artificial Sequence
  derived and/or modified sequence opt2 from anti-HIV-1_LightChain
gacauccagaugacccagucccccuccuccgucuccgccuccgucggcgaccgcgucaccaucaccugccgcgccucccagggcauccucuccucccagcucgccuggcaccagcagcgccgcggccagcccccccgccuccucaucuacggcggcuccaaccgcgcccccggcauccccgagcgcuucaccggcuccggcuccggcaccgacuucguccucaccaucaagcgccuccagcgcgacgacuucgccgucuacuacugccagauccucgaguucuucggccgcggcacccgcgucgagaugaac

SEQ ID NO: 16607 - RNA, 312 nt, Artificial Sequence
  derived and/or modified sequence opt2 from anti-HIV-1_LightChain
ggccuccuccucacccagucccccggccccgucuccuucuuccccggcgagcgcgccaccgucuccugccgcgccucccacuccgucaacuccgccgccaucaacugguaccagcagaagcgcggccagcccccccgccucaucaucgucgacggcuccacccgcgccaccgccguccccgagcgcuucuccgccaccggcuccggcaccgaguucacccucgucaucucccgccucgagcccgaggacuucgccgucuacuucugccagcaccuccaguucuucggccucggcaccaaggucgacaucaag

SEQ ID NO: 16608 - RNA, 312 nt, Artificial Sequence
  derived and/or modified sequence opt2 from anti-HIV-1_LightChain
gccuucgucaugacccagucccccggcacccucgcccucucccccggcgagcgcgccacccucuccugccgcaccucccaggagauccucuccaaccagcucgccuggcaccagcagcgccgcggccagcccccccgccuccucaucuacggcggcuccaaccgcgcccccggcauccccgagcgcuucaccggcuccggcuccggcaccgacuucguccucaccaucaaccgccucgagcgcgacgacuucgccgucuacuacugccagauccucgaguucuucggccgcggcacccgcgucgagaugaac

SEQ ID NO: 16609 - RNA, 312 nt, Artificial Sequence
  derived and/or modified sequence opt2 from anti-HIV-1_LightChain
ggcaucguccucacccagucccccgacacccucucccucucccccggcgaccgcgccacccucuccugcaagaccucccaguccaucgccuccgagcaccucgccugguaccagcagcgccccggccagcccccccgccuccucaucuucggcgccuccaaccgcgccuccggcauccccacccgcuucuccggcuccggcuccggcgccgacuucacccucuccaucacccgccucgagcccgaggacuucgccgucuacuacugccaguucuccgaguucuucggccgcggcgcccgcgucgaggucaag

SEQ ID NO: 16610 - RNA, 312 nt, Artificial Sequence
  derived and/or modified sequence opt2 from anti-HIV-1_LightChain
caguucgucaugacccagucccccgccacccucuccuccucccccggcggcaccgccacccucuccugccgcaccucccacuccauccucaacucccagcucgccuggcaccagcagcgccgcggccagccccuccgccuccucaucuacggcgccuccaaccgcgcccccggcauccccgagcgcuucuccgccuccggcuccggcaccgaguucguccucaccaucaagcgcauggagcgcgaggacuucgccgucuacuacugccagauccucgaguucuucggccagggcaccaccaucgacaugaac

SEQ ID NO: 16611 - RNA, 354 nt, Artificial Sequence
  derived and/or modified sequence opt2 from anti-HIV-1_HeavyChain
cgcguccaccucguccaguccggcacccaggucaagaagcccggcgccuccgucaaggucuccugcgagaccuccggcuucaaguuccucgacucccucauccacuggguccgccaggcccccggccagggccucuacuggaugggcuggaucaagcccuaccgcggcuccgucaacuacgacggcuacuuccgcggccgcgucuccaugacccgcgacaucuacaccgacaccgccuaccucgagcucuccggccuccgcuccgacgacaccgccaucuacuacugcgccuucggcgccggcgacggcugggaccucgucuggggccagggcacccucgucaucgucuccucc

SEQ ID NO: 16612 - RNA, 354 nt, Artificial Sequence
  derived and/or modified sequence opt2 from anti-HIV-1_HeavyChain
cgcguccaccucguccaguccggcacccaggucaagaagcccggcgccuccgucaaggucuccugcgagaccuccggcuucaaguuccucgacucccucauccacuggguccgccaggcccccggccagggccucuacuggaugggcuggaucaagcccuuccgcggcuccgucaacuacgacggcuacuuccgcggccgcgucuccaugacccgcgacaucuacaccgacaccgccuacauggagcucuccggccuccgcuccgacgacaccgccaucuacuacugcgccuucggcgccggcgacggcugggaccucgucuggggccagggcacccucgucaucgucuccucc

SEQ ID NO: 16613 - RNA, 354 nt, Artificial Sequence
  derived and/or modified sequence opt2 from anti-HIV-1_HeavyChain
cagguccaccucguccaguccggcacccaggucaagaagcccggcgccuccguccgcgucuccugcgagaccuccggcuucaaguuccucgacuccaucauccacugguuccgccaggcccccggcgagggccucuucuggaugggcuggaucaagcccuacaccggcuccgucaacuacguccgccgcuaccagggccgcgucuccaugacccgcgacgucuacuccgacaccgccuacauggaccucuccggccucaacuccgacgacaccgccgucuacuucugcaccuacggcgccggcgacggcuggaaccucgucuggggccagggcacccucgucaucgucuccgcc

SEQ ID NO: 16614 - RNA, 363 nt, Artificial Sequence
  derived and/or modified sequence opt2 from anti-HIV-1_HeavyChain
cagguccgccucguccaguccggcaaccagguccgcaagcccggcgccuccguccgcaucuccugcgaggccuccggcuacaaguucaucgaccacuucauccacuggguccgccagguccccggccacggccucgaguggcucggcuggaucaacccccgcggcggcggcgucaacuacucccgcggcuuccagggcaagcucuccaugaccaugacccgcgacaacuucgaggagaccgccuaccucgaccucucccgccucaaccccggcgacaccgccgucuacuacugcgcccgcggcuucgccggcuacgagugguccuuccucuggggccagggcacccucgucaucgucuccucc

SEQ ID NO: 16615 - RNA, 357 nt, Artificial Sequence
  derived and/or modified sequence opt2 from anti-HIV-1_HeavyChain
caggucucccucguccaguccggcaaccagcucaagaagcccggcgccuccguccgcaucuccugcgagaccuccggcuacaacuuccucaaccacuucauccacuggguccgccagguccccggccacggccucgaguggcucggcuggaucaacccccgcggcggcggcgucaacuacucccgcaacuuccagggcaaggucucccucacccgcaacaucgacauggagaccgucuaccucgacguccgcggccucacccccggcgacaccgccgucuacuacugcgcccgcggcuucggcggcuccgacuggaacuucgucuggggccagggcacccgcaucaccgucuccgcc

SEQ ID NO: 16616 - RNA, 357 nt, Artificial Sequence
  derived and/or modified sequence opt2 from anti-HIV-1_HeavyChain
cgcaucaaccuccaccaguccggcucccaggucaagcgcuccggcgccuccguccgcaucuccugcgagaccuccggcuucaaguucauggacucccaccuccacuggguccgccaggucgccggccagggcuucgaguggaugggcuggaucuucaccuccggcggcggcgucaacuacgcccgccaguuccagggccgccucacccucacccgcgacgucuucaccgacaccgucuucauggaccucuccggcgucaacgucggcgacaccggcgucuacuacugcgucaagggcaccggcggcaacgaguggggcuucuccuggggccagggcaccgucgucgucgucuccccc

SEQ ID NO: 16617 - RNA, 357 nt, Artificial Sequence
  derived and/or modified sequence opt2 from anti-HIV-1_HeavyChain
cgcaucaaccucgaccaguccggcucccaggucaagaaguccggcgccuccguccgcaucuccugcgagaccuccggcuucaaguucauggacucccaccuccacuggguccgccaggucgccggccagcccuucgaguggaugggcuggaucuucaccuccggcggcggcgucaacuacgcccgccaguuccagggccgccucacccucacccgcgacgucuucuccgagaccgucuucauggaccucuccggccucaacgccggcgacaccggcgucuacuucugcgucaagggcaccggcggcaacgaguggggcuucgucuggggccagggcaccgucgucgucgucuccccc

SEQ ID NO: 16618 - RNA, 357 nt, Artificial Sequence
  derived and/or modified sequence opt2 from anti-HIV-1_HeavyChain
cgcaucgagcuccaccaguccggcucccaggucaagaaguccggcgccuccguccgcaucuccugcgagaccuccggcuucaaguucauggacucccaccuccacuggguccgccaggucgccggccagcgcuucgaguggaugggcuggaucuucaccuccggcggcggcgucaacuacgcccgccaguuccagggccgccuccgccucacccgcgacgucuucuccgaguccgucuucauggaccucuccggccucaacuccggcgacaccggcgucuacuacugcgucaagggcaccggcggcaacgaguggggcuucgucuggggccagggcucccucgucgucgucuccccc

SEQ ID NO: 16619 - RNA, 372 nt, Artificial Sequence
  derived and/or modified sequence opt2 from anti-HIV-1_HeavyChain
caggcccucguccaguccggcucccagaugaagaagcccggcgacuccguccgccucuccugccagaccuccgacuccgccaucaccaaguacuucauccacuggauccgccaggcccccggcaagggccucgaguggaucgccuggaucucccccuacggcggccgcgucaacuacggcuggcagguccgcgaccgcgccacccucacccgcaacauccacauggagaccgucuacauggaccuccgcggccuccgccccgacgacaccgccaccuacuacugcgccaugcgcgacuacugccgcgacgacaacugcaaccgcugggaccucggccacuggggccagggcucccucaucgucgucuccgcc

SEQ ID NO: 16620 - RNA, 357 nt, Artificial Sequence
  derived and/or modified sequence opt2 from anti-HIV-1_HeavyChain
caggucacccucguccaguccggcaaccagcucaagcgccccggcgccuccguccgcaucuccugcgagaccuccggcuacaacuucauggaccacuucauccacuggguccgccagguccccggccacggccccgaguggcucggcugggucaacccccgcggcggcggcgucaacuacucccgcaaguuccagggccgcuucuccaugacccgcgacgucuacauggagaccgccuaccucgacgucaccggccucucccccgccgacaccgccgucuacuacugcgcccgcggcuucggcggcuccgacugguccuuccucuggggccagggcacccucaucaucgucuccucc

SEQ ID NO: 16621 - RNA, 324 nt, Artificial Sequence
  derived and/or modified sequence opt2 from anti-HIV-1_LightChain
gagaucguccucacccagucccccggcacccucucccucuccgccggcgagcgcgccucccucuccugccgcgccucccagacccucaacuccaacuucuucgccugguaccaccagaagcccggccaggccccccgccuccucaucuacggcgccuccaaccgcgccaccggcauccccgaccgcuucuccggcuccggcuccggcuccgacuucacccucaccaucucccgccucgagcccgaggacuucggcaaguacuacugcgagcaguacgacgucuccccccgcaccuucggccagggcaccaaggucgagaucaag

SEQ ID NO: 16622 - RNA, 324 nt, Artificial Sequence
  derived and/or modified sequence opt2 from anti-HIV-1_LightChain
gaggucguccucacccagucccccggcacccucucccucucccccggcgagcgcgccacccucuccugccgcgccucccaguccaucaacuccaacuucuucgccugguaccaccagaagcccggccaggccccccgccuccucaucuacggcgccuccucccgcgccaccggcauccccgaccgcaucuccggcaccggcuccggcgccgacuucacccucaccaucaccggccucgagcccgaggacuucggccucuacuacugccagcaguacgacuucuccccccgcaccuucggccagggcacccgcgucgagaucaag

SEQ ID NO: 16623 - RNA, 324 nt, Artificial Sequence
  derived and/or modified sequence opt2 from anti-HIV-1_LightChain
gaggucguccucacccagucccccggcacccucucccucucccccggcgagcgcgccacccucuccugccgcgccucccagaccaucaacuccaacuucuucgccugguaccaccagaagcccggccaggccccccgccuccucaucuacggcgccuccucccgcgccaccggcauccccgaccgcaucuccggcuccggcuccggcaccgacuucacccucaccaucaccggccucgagcccgaggacuucggccucuacuacugccagcaguucgacuucuccccccgcaccuucggccagggcacccgcgucgagaucaag

SEQ ID NO: 16624 - RNA, 324 nt, Artificial Sequence
  derived and/or modified sequence opt2 from anti-HIV-1_LightChain
gagaucguccucacccagucccccggcacccucucccucgcccccggcgagcgcgccacccucuccugccgcgccucccaguccaucuccaccaccuaccucgccugguaccagcagaagcccggccaggccccccgccuccucaucuacgagaccuccucccgcgccuccgacauccccgaccgcuucuccggcuccggcuccggcaccgacuucacccucaccaucucccgccucgagcccgaggacuucgccgucuacuacugccaccaguacgaccgcuccccccgcaccuucggccagggcaccaaggucgagaucaag

SEQ ID NO: 16625 - RNA, 336 nt, Artificial Sequence
  derived and/or modified sequence opt2 from anti-HIV-1_LightChain
gacaucgucaugacccagucccccgccucccucuccgucacccccggcgagaccgccuccaucuccugcaagugcucccgcucccuccgcgaggaggucggcuacaacuaccucgacugguaccuccagcgccccggcaaguccccccagcuccucaucuacgucggcuccuuccgcgcccccggcgucuccgagcgcuuccgcggcuccggcgagcacaaggacuucacccucaagaucgcccgcgucgagcccggcgacgccggcaucuacuacugcaugcagggcaucgacaccccccgcaccuucggccagggcaccacccucgagaucaac

SEQ ID NO: 16626 - RNA, 321 nt, Artificial Sequence
  derived and/or modified sequence opt2 from anti-HIV-1_LightChain
gacauccagaugacccagucccccuccucccucuccgccuccgucggcgaccgcgucaccaucaccugccgcgccucccaggccuuccgcaacgaccucggcugguaccagcacaagcccggcaaggcccccgagcgccucaucuacgccaccuccacccucgaguccggcguccccucccgcuucuccggcuccggcuccggcaccaacuucacccucaccaucuccucccuccaggccgaggacuucgccaccuacuacugccuccaguacaacaccuucccccgcaccuucggccagggcaccaaggucgagaucaag

SEQ ID NO: 16627 - RNA, 333 nt, Artificial Sequence
  derived and/or modified sequence opt2 from anti-HIV-1_LightChain
aacuucaugcucacccagccccacuccgucuccgagucccccggcaagaccgucaccaucuccugcgcccgcacccgcggcggcaucgacuccgccuacguccacugguaccagcagcgccccggcuccguccccaccaccgucaucuucgaggacaaccgccgcccccccggcguccccgaccgcuucuccggcuccaucgacaccuccuccaacaccgccucccucaccaucuccggccucaagaccgaggacgaggccgacuacuacugccaguccuacgacgacaccuacuucugggucuucggcggcggcaccaagcucaccguccuc

SEQ ID NO: 16628 - RNA, 333 nt, Artificial Sequence
  derived and/or modified sequence opt2 from anti-HIV-1_LightChain
aacuucaugcucacccagccccacuccgucuccgagucccccggcaagaccgucaccaucuccugcgcccgcacccgcggcaccaucgacuccgccuacguccacugguaccagcagcgccccggcgccguccccaccaccgucaucuucgaggacgaccgccgccccuccggcguccccgaccgcuucuccggcuccaucgacuccuccuccaacuccgccucccucaccaucuccggccucaagaccgaggacgaggccgacuacuacugccaguccuacgacuccaacuacuacugggucuucggcggcggcaccaagcucaccguccuc

SEQ ID NO: 16629 - RNA, 396 nt, Artificial Sequence
  derived and/or modified sequence opt2 from anti-HIV-1_HeavyChain
cagguccagcuccagcaguccggccccgcccucgucaagcccuccgagacccucucccucaccugcuccgucuccuccggccgcgucuccuccuacuacugguccuggauccgccagucccccggcaagggccucgaguggaucggcuacauccacuacgaccccgacaccaacaccaacuaccgcacccacuaccaccccucccuccgcggccgcgucgucaucuccgucgacuccuccaagucccaggucucccucaagguccgcuccgucaccgccgccgacuccgcccucuacuacugcgcccgccaccgcuacgaccccugguccaagggcuacgacauccgcucccccuucgacuucuggggccagggcacccucgucaccgucuccucc

SEQ ID NO: 16630 - RNA, 396 nt, Artificial Sequence
  derived and/or modified sequence opt2 from anti-HIV-1_HeavyChain
cagguccaccuccagcaguccggccccggccucgucaagcccuccgagacccucucccucaccugcaccgucuccggcggccgcgucuccuccuacuacugguccuggauccgccagucccccggcaagggccucgaguggaucggcuacauccacuacgaccccgacaccuccaccaacuaccgcacccacuaccaccccucccuccgcggccgcgucgucaucuccgucgacaccuccaagaaccaggucucccucaccguccgcuccgucaccgccgccgacuccgcccucuacuacugcgcccgccaccgcuacgacgucugguccaacggcuacgacauccgcucccccuacgacuucuggggccgcggcacccucgucaccgucuccucc

SEQ ID NO: 16631 - RNA, 396 nt, Artificial Sequence
  derived and/or modified sequence opt2 from anti-HIV-1_HeavyChain
cagguccaccucgagcaguccggccccgcccucgucaagcccuccgagacccucucccucaccugcaccgucuccggcggccgcgucuccuccuacuacugguccuggauccgccagucccccggcaagggccucgaguggaucggcuacauccacuacgaccccgacaccuccaccaacuaccgcacccacuaccaccccucccuccgcggccgcgucgucaucuccgucgacuccuccaagaaccaggucucccucaagguccgcuccgucaccgccgccgacuccgcccucuacuacugcgcccgccaccgcuacgacgucugguccaagggcuacgacauccgcucccccuucgacuucuggggccgcggcacccucgucaccgucuccucc

SEQ ID NO: 16632 - RNA, 390 nt, Artificial Sequence
  derived and/or modified sequence opt2 from anti-HIV-1_HeavyChain
caggucgucuuccagaagcccggccccggcgucgucaagcccuccgagacccucucccucaccugcaccgucuccggcggccgcguccgcuccuacuacugguccuggauccgccucccccccggccagggccucgaguggaucggcuacauccacuacgacgagaccaccgaguacaagcgcuccuacaaccccucccucaagucccgcaucaccaucuccauggacaccuccaagaaccaggucucccucaagcucuccuccgucaccgccgccgacgccgccgucuacuacugcgcccgccaccgcuacgaccgcugguccgacuccuacgacauccgcucccccuucgacaucuggggccagggcaccgucgucaccgucuccgcc

SEQ ID NO: 16633 - RNA, 396 nt, Artificial Sequence
  derived and/or modified sequence opt2 from anti-HIV-1_HeavyChain
cagguccagcuccagcaguggggcgccggccuccucaagcccuccgagacccucucccucaccugcgccaucuacggcuccuccuucuccggccacuacuggauguggauccgccagucccccgccaagacccucgaguggaucgccgagaucaaccacaccggcggcacccgcuacaaccccucccucgccucccgcguccgcgucuucuccgacaccuccaagaaccaguucucccucaacaugaccucccucaccgccgccgacaccggcaucuacuacugcguccgcggccaccucucccgcgaccgccucggccaguacgccuucugguccggcgcccucaucgacuaccucgaccccuggggccagggcacccucgucaccgucuccucc

SEQ ID NO: 16634 - RNA, 387 nt, Artificial Sequence
  derived and/or modified sequence opt2 from anti-HIV-1_HeavyChain
cagguccagcuccaccaguggggcgccggccuccucaagcccuccgagacccucucccucaccugcgccgucuacggcuccuucaccggcuuccaguggaccuggguccgccagacccccggcaagggccucgaguggaucggcgagaucaaccacuccggccuccucgucaccggcaagaccgacuacaaccccucccucgagucccgcgucaccaucuccgucgacaccuccaagaaccaguucucccucaagcucaccuccgucaccgccgccgacaccggcgucuacuacugcgcccgcgccggcggcauguccgacugggccuaccccuacuacuacggcauggacgucuggggccagggcaccauggucaccgucuccucc

SEQ ID NO: 16635 - RNA, 357 nt, Artificial Sequence
  derived and/or modified sequence opt2 from anti-HIV-1_HeavyChain
cagguccagcucgucgaguccggcggcggcgucguccagcccggccgcucccucacccucuccugcgccaccuccggcuucgacuucuccuccuacggcuuccacuggguccgccaggcccccggcaagggccuccagugggucuccaucaucucccacgacggcuccaucaagaacuacggcgacuccaugaagggccgcuucuccgucucccgcgacaacgccaaggacauccucuaccuccagaugaacucccuccgccccgacgacaccgcccucuaccacugcguccgcggcgacggcgagaacggcggcaccgacuacuggggccucggcacccucgucaccgucuccgcc

SEQ ID NO: 16636 - RNA, 357 nt, Artificial Sequence
  derived and/or modified sequence opt2 from anti-HIV-1_HeavyChain
caggucgaccucgucgaguccggcggcggcgucguccagcccggcaagucccucaagcucuccugcaccgccuccggcuucaccuucaccuccuacggcaugcacuggguccgccagauccccggcaagggccucgagugggucgccaucaucucccacgacggcaccaucaagaacuacggcgacuccgucaagggccgcuucaccaucucccgcgacaacgccaugaacauccucuaccuccagaugaacaaccuccgcggcgacgacaccgcccucuacuacugcguccgcggcgacggcgagaacggcggcaccgacuacuggggccagggcaccgucgucaccgucuccucc

SEQ ID NO: 16637 - RNA, 369 nt, Artificial Sequence
  derived and/or modified sequence opt2 from anti-HIV_V3_HeavyChain
gagguccagcucguccaguccggcgccgaggucaagaagcccggcgagucccucaagaucuccugccagggcuucggcuacaccuucuccaccuacuggaucggcuggguccgccagaugcccggcaagggccucgaguggcucggcaucaucuaccccgaggacuccgagaccaucuacucccccuccuuccagggccaggccaccaucuccgccgacaagucccucuccaccgccuaccuccagugguccggccuccgcgccuccgacuccgccaucuacuacugcgcccgccucggcuacugcggcuccaccuccugcuccuucuucgacuucuggggccgcggcacccucgucaccgucuccucc

SEQ ID NO: 16638 - RNA, 369 nt, Artificial Sequence
  derived and/or modified sequence opt2 from anti-HIV_V3_HeavyChain
gagguccagcucguccaguccggcgccgaggucaccaagcccggcgagucccucaagaucuccugcaagggcuccggcuacuccuucuccacccacuggaucgccuggguccgccagaugcccggccgcggccucgaguggaugggcuucaucuaccccgacgacuccgacacccgcuacucccccucccuccagggccacgucaucaucuccgccgacaagucccucuccaccgccuaccuccagugguccucccucaaggccuccgacaccgccauguacuacugcgcccgccucggcggcgacgaguaccaguccuccggcggcauggacgucuggggccagggcaccaccgucaucgucuccucc

SEQ ID NO: 16639 - RNA, 393 nt, Artificial Sequence
  derived and/or modified sequence opt2 from anti-HIV_V3_HeavyChain
gagguccagcucguccaguccggcgccgaggucaagaagcccggcgccaccgucaagaucuccugcaaggucuccggcuacacccucaccgacuacuacauccacuggguccagcaggcccccggccgcggccucgaguggcucggccucgucgaccccgagaacggcgagacccucuacgccgagaaguuccagggccgcgucacccucaccgccgacaccuccaccgacaccgccuacauggagcucaagucccuccgcuacgaggacaccgccgucuacuacugcgccaccgagggcccccccuccuacuacgacuccggcaccuacgccaagucccuccccgccuccuucgccugcuggggccagggcacccucgucaccgucuccucc

SEQ ID NO: 16640 - RNA, 369 nt, Artificial Sequence
  derived and/or modified sequence opt2 from anti-HIV_V3_HeavyChain
cagguccagcuccaggaguccggccccggccucgucaagcccuccgagacccucucccucaccugcaccgucuccggcggcuccaucaacaacuacuacugguccuggauccgccagccccccggcaagggccucgaguacaucggcuacaucuucuacuccggcuccaccaacuacaaccccucccucaagucccgcgucaccuucuccgucgacaccuccaagaaccaguucucccucaagcucaccuccgucaccgccaccgacaccgccgucuacuacugcgcccgcggcccccuccucuacuucggcgccccccgcacccacuucgacuacuggggccagggcgcccucgucaccgucuccucc

SEQ ID NO: 16641 - RNA, 372 nt, Artificial Sequence
  derived and/or modified sequence opt2 from anti-HIV_V3_HeavyChain
gagguccagcucguccaguccggcgccgaggucaagaagcccggcgagucccucaagaucuccugcaagggcuccggcuacuccuucuccucccacuggaucggcuggguccgccagcuccccggcaagggccucgaguggaugggcaucaucuaccccgacgacuccgacaccaaguacaaccccuccuuccagggccaggucaccaucuccgccgaccgcuccaucuccaccgccuaccuccagugguccucccucaaggccuccgacaccgccauguacuacugcgcccgcgucggcuacgacuccuacggcuacuccggcuccaacuucgacgaguggggccagggcacccucgucaccgucuccucc

SEQ ID NO: 16642 - RNA, 357 nt, Artificial Sequence
  derived and/or modified sequence opt2 from anti-HIV_V3_HeavyChain
gagguccagcucguccaguccggcgccgaggucaagaagcccggcgagucccucaagaucuccugcaagggcuccggcuacaacuucaacuccgacuggaucggcuggguccgccagaugcccggcaagggccucgagugggucggcaugaucuaccccgacgacuucgagguccgccacuccccccccuuccagggccgcgucaccauguccgucgacaaguccaucuccaccgccuaccuccagugguccucccucaaguccuccgacaccggcauguacuucugcgcccgccucgacggcaacgccgccgccuucgacuacuggggccagggcacccaggucaccgucuccucc

SEQ ID NO: 16643 - RNA, 360 nt, Artificial Sequence
  derived and/or modified sequence opt2 from anti-HIV_V3_HeavyChain
gacguccagcucguccaguccggcgccgaggucaagaaggccggcgagucccucaagaucuccugccgccccuccggcuacaacuucgccgacuacuggaucggcuggguccgccagaugcccggcaagggccucgaguggaugggcaucaucuuccccgacgacuccgacacccgcuacggccccuccuucgagggccaggucaccaucuccgccgacaaguccaucaacaccgccuaccuccaguggaacucccucaaggccuccgacaccgccauguacuucugcgcccgccacggcggcuccggcgccgcccccggcgacuacuggggccagggcacccucgucaccgucuccucc

SEQ ID NO: 16644 - RNA, 363 nt, Artificial Sequence
  derived and/or modified sequence opt2 from anti-HIV_V3_HeavyChain
gagguccagcucguccaguccggcgccgaggucaagaagcccggcgccaccgucaagaucuccugcaaggucuccggcuacaccuucaccgacuacuucaugcacuggguccaggaggcccccggcaagggccucgccuggaugggccucgucgaccccgagaacggcgacaccgucuacgccgagaagcuccagggccgcgucaccauguccgccgacaccucccgcgacaccgccuacauggagcucaccucccuccgcuccgaggacaccgccgucuacuacugcgccaucggcaaguccgucgccggcaccuccgccuacgacaucuggggccagggcaccauggucaccgucuccucc

SEQ ID NO: 16645 - RNA, 369 nt, Artificial Sequence
  derived and/or modified sequence opt2 from anti-HIV_V3_HeavyChain
cagguccagcucguccaguccggcgccgagguccgcaagcccggcgccuccgucaaggucuccugcaaggccuccggcgacaccuucaacaaccacgacaucaacuggguccgccaggcccccggccagggccccgagugggucggcuggaugaaccccaaguccggcaacgccggcuacgcccagaaguuccagggccgcgucaccaugacccgcgacaccuccaucuccaccgccuacauggagcuccgcucccucaccuccgaggacaccggcgucuacuacugcgcccgccucaccgucgacugcgacgacggcggcugcuacggcgacuacuggggccagggcacccucgucaccgucuccucc

SEQ ID NO: 16646 - RNA, 354 nt, Artificial Sequence
  derived and/or modified sequence opt2 from anti-HIV_V3_HeavyChain
gaggucuaccuccagcaguccggcgccgagcucaaggagcccggcgccaacgucaagaucuccugcaaggccuucggcuucaucuucaccgacuacuucauccacuggcuccgccaggcccccggcaagggcccccagugggucggcgucgucgaccccgaggacggcuccaccaccuacgccgaggccuuccagggccgcgucuccaucaccgccgaccgcuccaccgacaccgccuacauggaccucgccggccucaccuccgacgacaccgccgucuacuacugcgcccucauguggaacgaguccggccccgacaacuggggccagggcacccucgucaucgucuccucc

SEQ ID NO: 16647 - RNA, 393 nt, Artificial Sequence
  derived and/or modified sequence opt2 from anti-HIV_V3_HeavyChain
gagguccaggucgucgaguucggcggcgaggucaagaagcccggcgccuccgucaaggucuccugcgaggccuccggcuacaccuucgccaaguucgccauccacuggguccgccaggccccccgccagggccucgaguggaugggcuggaucaacggcgacgacggcaagaccgaguacucccagaaguuccaggaccgcgucaccaugacccgcgacaccuccgccuccaccgucuacauggagcucuccucccuccgcuccgaggacaccgcccucuacuacugcgcccgcgccauguaccccgacaccgucaccggcaacgacaaccccgcccccccccccuucgagggcgacuacuggggccagggcacccucgucaccgucuccucc

SEQ ID NO: 16648 - RNA, 393 nt, Artificial Sequence
  derived and/or modified sequence opt2 from anti-HIV_V3_HeavyChain
gagguccagcucgucgaguccggcggcggccucgucaagcccggcggcucccuccgccucaccugcgucgccuccggcuucaccuucuccgacgucuggcucaacuggguccgccaggcccccggcaagggccucgagugggucggccgcaucaagucccgcaccgacggcggcaccaccgacuacgccgccuccgucaagggccgcuucaccaucucccgcgacgacuccaagaacacccucuaccuccagaugaacucccucaagaccgaggacaccgccgucuacuccugcaccaccgacggcuucaucaugauccgcggcgucuccgaggacuacuacuacuacuacauggacgucuggggcaagggcaccaccgucaccgucuccucc

SEQ ID NO: 16649 - RNA, 387 nt, Artificial Sequence
  derived and/or modified sequence opt2 from anti-HIV_CD4bs_HeavyChain
gaggagcagcucgucgaguccggcggcggccucgucaagcccggcggcucccagcgccucuccugcgccgccuccgaguucaccuucucccgcuacaccaugaacuggguccgccaggcccccggcaagggccucgagugggucuccuccaucuccggcaacgacaacaacaucuacuacgccgacuccgucaagggccgcuucaccaucucccgcgacaacgcccgcaacucccucuaccuccagaucaacucccuccgcgucgaggacaccgccgucuacuacugcgcccgcggcccccucgacuccuacgacuucugguccggcucccgccacuacuacggccucgacgucuggggccagggcaccaccgucaccgucuccucc

SEQ ID NO: 16650 - RNA, 372 nt, Artificial Sequence
  derived and/or modified sequence opt2 from anti-HIV_CD4bs_HeavyChain
cagguccagcucguccaguccggcuccgagcucaagaagcccggcgccuccgucaaggucuccugcaaggccuccggcuacaccuucaccucccacaucaucaacuggguccgccaggcccccggccagggccucgaguggaugggcuggaucaacaccaacaccggcaaccccaccuacgcccagggcuucaccggccgcuucgucuucucccucgacaccuccgucuccauggccuaccuccagaucuccucccucaaggccgaggacaccggcgucuacuacugcgcccgcggcuuccgccaguggcucgucgcccgcaucaccuacuucgacuacuggggccagggcacccucgucaccgucuccucc

SEQ ID NO: 16651 - RNA, 369 nt, Artificial Sequence
  derived and/or modified sequence opt2 from anti-HIV_CD4bs_HeavyChain
gagcuccgccuccaggccuccggccccggccucgucaagcccuccgagacccucucccucgucugcuccgucuccggcgucuccaucuccgacuccuacuggaacuggauccgccagcccgccggcaagggccucgaguggaucggccgcgucuacacccgcggcacccacaccuacaaccccucccucggcggccgcgccaccgucuccggcgacaccaacaagaacgaggucucccucaagcucauguccgucaccgccgccgacaccgccgucuacuacugcgcccgcgcccucuccggcgacuggacccgccgcuacuucuacauggacgucuggggccgcggcacccccgucaccgucuccucc

SEQ ID NO: 16652 - RNA, 381 nt, Artificial Sequence
  derived and/or modified sequence opt2 from anti-HIV_CD4bs_HeavyChain
cagcuccagcuccaggaguccggcccccgccucgucaagcccuccgagacccucucccucaccugcaccgucuccggcggcuccaucuccuccggcgacuacuacuggaccuggauccgccagccccccggcgagggccucgaguacaucggcuacaucuacuccggcggcuccaccgacuacaaccccucccucaagucccgcgccuccaucucccaggacaccuccaccaacgaguucucccucaagcucaccuccgucaccgccgccgacaccgccgucuacuucugcgcccgcgaccgccgcguccuccucugguucggcgagccccgccgcggccucgacuucuggggccccggcacccucgucaccgucuccucc

SEQ ID NO: 16653 - RNA, 396 nt, Artificial Sequence
  derived and/or modified sequence opt2 from anti-HIV_CD4bs_HeavyChain
gagguccagcucgucgaguccggcggcggccucgucaagcccggcggcucccuccgccucuccugcgccgccuccggcuucaccuucuccuccgccuggauguccuggguccgccaggcccccggcaagggccucgagugggucggccgcaucaaguccaaguccgacggcgagaccaccgacuacgccgcccccgucaagggccgcuucaccaucucccgcgacaaccucgaguccacccucuaccuccagcucaacucccucaagaccgaggacaccgccgucuacuacugcgccaccgccacccccuccuacuacgacaucaugaccggcaacuacaaguacuacuacuacauggacgucuggggcaagggcaccaccgucaccgucuccucc

SEQ ID NO: 16654 - RNA, 363 nt, Artificial Sequence
  derived and/or modified sequence opt2 from anti-HIV_CD4bs_HeavyChain
cagguccagcucgucgaguccggcggcggccucgucaagcccggcggcucccuccgccucuccugcgccgccuccggcuucaucuuccgcgaccacuacaugaccuggauccgccaggcccccggcaagggccucgagugggucuccuacaucuccuccuccuccaacaacauccaguacgccgacuccgucaagggccgcuucaccgucucccgcgacaacgccaagaacucccucuaccuccagaugaacucccuccgcgccgacgacaccgccgucuacuacugcgcccgcuccggccccuucuacaacuacggcccccccaacaacuggggccagggcacccucgucaccgucuccucc

SEQ ID NO: 16655 - RNA, 378 nt, Artificial Sequence
  derived and/or modified sequence opt2 from anti-HIV_CD4bs_HeavyChain
cagguccagcucgucgaguccggcggcggcgucguccagcccggcggcucccucacccucuccugcaccgccuccggcuuccccuucaacuccuacgccaugcacuggguccgccaggcccccggcaagggccucgagugggucuccaugaccucccacgacggcggcaacaaggacuucgucgacuccgucaagggccgcuucaccaucucccgcgacaacucccgcaacacccucuuccuccagaugaacucccucucccaggacgacaccggcgucuacuacugcguccgcggcaagcucgaggacuacaacuucuggggccacuaccgcgacuucgacuccuggggccagggcacccucgucaccgucuccgcc

SEQ ID NO: 16656 - RNA, 405 nt, Artificial Sequence
  derived and/or modified sequence opt2 from anti-HIV_CD4bs_HeavyChain
gagccccacgucgucgaguccggcggcggcauggccaagcccggcggcucccuccgccucuccugcgccggcuccggcuucaccuucaccaacgccuggaugaacuggguccgccaggcccccggcaagggccucgagugggucggccucaucaaguccaaguccgacggcggcaccaccgacuacgccgccgacgucgagggccgcuucaccaucucccgcgacgaccucgaguccaccauguuccucgagaugcacucccuccagaucgaggacaccgccgucuacuucugcaccacccaguacccccgcuacuacgaccucaugaccggcaacuacaagcgccgcuacuucuccuccggcauggacgucuggggccagggcaccgccgucaccgucuccucc

SEQ ID NO: 16657 - RNA, 384 nt, Artificial Sequence
  derived and/or modified sequence opt2 from anti-HIV_CD4bs_HeavyChain
cagguccagcuccaggaguccggccccggccucgucaagcccucccagacccucucccucaccugcaccgucuccggcgacuccgucuccuccggcaacuacuacugguccuggauccgccagcccgccggcaagccccucgaguggaucggccacaucuccaccggcggcggcaccaagaacaaccccucccuccagucccgcgucaccaucucccucgacuccuccaagaaccaggucucccucucccucuccuccgucaccgccgccgacaccgccgucuacaccugcgcccgcggccccccccgcucccucugguucggcgaccccaccuacuccuacauggacgucuggggcaagggcaccaccgucaccgucuccucc

SEQ ID NO: 16658 - RNA, 372 nt, Artificial Sequence
  derived and/or modified sequence opt2 from anti-HIV_CD4bs_HeavyChain
cagguccagcucguccaguccggcgccgaggucaagaagcccggcuccuccgucaaggucuccugcaaggccuccggcggcaccuucaacucccacgccuucaccuggguccgccaggcccccggccagggccucgaguggaugggcggcaucauccccacccucggccucgccaacgacgcccagaaguuccagggccgcuucaccaucaccgccgacgaguccaccaccaccgucuacauggagcucuccucccuccgcuccgaggacaccgccgucuacuacugcgcccgccgccccuacuacgaccaggucuccggcgucggcgccuucgacaucuggggccagggcacccgcgucaccgucuccucc

SEQ ID NO: 16659 - RNA, 390 nt, Artificial Sequence
  derived and/or modified sequence opt2 from anti-HIV_V2_HeavyChain
cagguccagcucguccaguccggcgccgaggucaagaagcccggcuccuccgucaaggucuccugcgaggccuccggcgucaccuccuccuccuacaccaucuccuggguccgccucgcccccggccagggccucgaguggaugggccgcaucacccccaucuucgacaucaccaacuacgcccagaaguuccagggccgcgucacccucaccgccgacaaguccaccggcaccaccuacauggagcucuccucccuccgcuccgacgacaccgccgucuacuacugcgcccgcgacaaguccgacgucgucgucgucaccuccauccgccccgccuacuacuacggcauggacgucuggggccagggcaccaccgucaccgucuccucc

SEQ ID NO: 16660 - RNA, 366 nt, Artificial Sequence
  derived and/or modified sequence opt2 from anti-HIV_V2_HeavyChain
cagguccagcucguccaguccggcgccgaggucaagaagcccggcuccuccgucaaggucuccugcaaggccuccggcggcaccuuccgcuccuacgccaucuccuggguccgccaggcccccggccagggccucgaguggaugggcggcaucauccccaucuucggcaccgccgacuacgcccagaaguuccagggcaaggucaccaucaccgccgacgaguccaccuccaccgccuacauggagcucuccucccucaccuccgaggacaccgccauguacuacugcgcccgcucccgcgaccacuucuucgacacccgcgucuuccagggcuggggccagggcacccucgucaccgucuccucc

SEQ ID NO: 16661 - RNA, 363 nt, Artificial Sequence
  derived and/or modified sequence opt2 from anti-HIV_V2_HeavyChain
cagguccagcucguccaguccggcgccgaggucaagaagcccggcuccuccgucaaggucuccugcaaggccuccggcggcaacuucaacaccuacaccaucuccuggguccgccaggcccccggccagggccucgaguggaugggccgcaucauccccaucuucggcaucgucaaccccgcccagaaguuccccggccgcgucaccaucaacgucgacaaguccaccaacaccgccuacauggagcucuccucccuccgcuccgaggacaccgccgucuacuacugcgccaccuccggcgucggccuccacuucggcuacuucgacuacuggggccagggcacccaggucaccgucuccucc

SEQ ID NO: 16662 - RNA, 378 nt, Artificial Sequence
  derived and/or modified sequence opt2 from anti-HIV_V2_HeavyChain
cagguccagcuccagcaguggggccccggccuccucaagcccuccgagacccucucccucaccugcgccgucuacggcggcuccuucggccgcuacuacugguccuggauccgccaguccuccggcgagggccucgaguggcucggccagaucgaccacaccggcuccaccaccuacaaccccucccucaagggccgcgucaccaucuccaucgacuccuccaccaaccaguucucccucaaggucaccuccgucaucgccgccgacaccgccgucuacuacugcgcccgcgcccccuccggcuaccccggcgucucccucuaccaguacuacggccucgacgucuggggccagggcaccaccgucaccgucuccccc

SEQ ID NO: 16663 - RNA, 366 nt, Artificial Sequence
  derived and/or modified sequence opt2 from anti-HIV_V2_HeavyChain
cagguccagcucguccaguccggcgccgaggucaagaagcccggcuccuccgucaaggucuccugcaaggccuccggcggcaccuucuccaacuacgccaucuccuggguccgccaggcccccggccagggccucgaguggaugggcggcaucauccccaucuucggcaccaccgacuacgcccagaaguuccagggccgcgucaccaucaccgccgacgccuccaccuccaccgccuacauggagcucuccucccuccgcuccgacgacaccgccgucuacuacugcgcccgcucccgcggccacuacuucgacacccgcgucuucgagggcuggggccagggcacccucgucaccgucuccucc

SEQ ID NO: 16664 - RNA, 372 nt, Artificial Sequence
  derived and/or modified sequence opt2 from anti-HIV_V2_HeavyChain
cagguccaccucguccaguccggcaccgaggucaagaagcccggcgccuccgucaccgucuccugcaaggccuccggcuacuccuucaccggcuacuaccuccacuggguccgccaggcccccggccagggccucgaguggaugggcuggaucaaccccaacuccggcggcaccuacuacgcccagaacuuccaggcccgcgucaccaugacccgcgacaccuccaucuccaccgucuacauggaccucucccgccuccgcuccgacgacaccgccgucuacuacugcguccgccgcgccguccucaccgcccuccccccccgcuacuacuucgacuucuggggccagggcacccucgucaccgucuccucc

SEQ ID NO: 16665 - RNA, 318 nt, Artificial Sequence
  derived and/or modified sequence opt2 from anti-HIV_V3_LightChain
ucccucgagcucacccagccccccuccgucuccgucucccccggccagaccgucuccaucaccugcuccggcaaccuccucggcgacaaggacgccuccugguaccagcucaagcccggccagucccccauccucgucaucuaccucgacaccgagcgccccuccggcauccccgagcgcuucuccggcuccaaguccggcaacaccgccacccucaccaucuccggcacccaggccauggacgaggccgaguacuucugccaggccugggacaccaccaccguccucuucggcggcggcacccgccucaccguccuc

SEQ ID NO: 16666 - RNA, 324 nt, Artificial Sequence
  derived and/or modified sequence opt2 from anti-HIV_V3_LightChain
uccgacgagcucacccagccccccuccgucuccgucucccccggccagaccgcccgcaucaccugcuccggcgacgcccuccccgagaaguacgccuacugguaccagcagaaguccggccaggcccccguccucgucaucgacgaggacaacaagcgccccuucggcacccccgagcgcuucuccggcucccgcuccggcaccauggccacccucaccaucaccggcgcccagauggaggacgaggccgacuacuacugcuccuccaccgacucccgcggcaccuacugggucuucggcggcggcaccaagcucaccguccuc

SEQ ID NO: 16667 - RNA, 336 nt, Artificial Sequence
  derived and/or modified sequence opt2 from anti-HIV_V3_LightChain
caguccguccucacccagccccccuccgucuccgccgcccccggccagaaggucaccaucuccugcuccgccggcaacuccaagaucggcgacaacuacaucuccugguaccagcacguccccggcgccgcccccaagcuccucaucuacgagaacgacaagcgccccuccggcauccccgaccgcuucuccggcuccaaguccggcaccuccgccucccucggcaucaccggccuccagaccggcgacgaggccgacuacuacugcgccgccugggacaacucccucuccuccgcccucuacgucuucggcaccggcaccaaggucaccguccuc

SEQ ID NO: 16668 - RNA, 339 nt, Artificial Sequence
  derived and/or modified sequence opt2 from anti-HIV_V3_LightChain
gacaucgucaugacccagucccccgacucccucgccgucucccucggcgagcgcgccaccaucaacugcaaguccucccagaacgucuucuacuccuccaacaaccgcaacuaccucgccugguaccagcagcgccccggccagccccccaagcuccucuucuacugggccuccacccgcgaguccggcguccccgaccgcuucuccggcuccggcuccggcaccgacuucacccucaccaucuccucccuccagaccgaggacgucgccaucuacuacugccagcaguacuacaacaccccccccaccuucggccccggcaccaaggucgagaucaag

SEQ ID NO: 16669 - RNA, 318 nt, Artificial Sequence
  derived and/or modified sequence opt2 from anti-HIV_V3_LightChain
uccuacgagcucacccagccccccuccgucuccgucucccccggccagaccgccaccaucaccugcuccggcgaccuccucggcgacaaguacgccuccugguaccgccagaagcccggccagucccccguccucgucaucuacgaggacaccaagcgccccuccggccuccccgagcgcuucuccggcuccaacuccggcaacaccgccacccucaccaucuccgagacccaggccauggacgaggccgacuacuacugccaggccugggacacccgcaccgucgucuucggcggcggcaccaagcucaccguccuc

SEQ ID NO: 16670 - RNA, 327 nt, Artificial Sequence
  derived and/or modified sequence opt2 from anti-HIV_V3_LightChain
caguccguccucacccagccccccuccgucuccgccgcccccggccagaaggucaccaucuccugcuccggccgcuccuccgacaucgagaacaaguucgucuccugguaccagcagcuccccggcaccgcccccaagcuccucaucuacgaggacaacaagcgccccuccggcauccccgaccgcuucuccggcuccaaguccggcaccuccgccacccucggcaucaccggccuccagaccggcgacgaggccgacuacuacugcggcaccugggacaacaaccuccgcgccggcuucggcggcggcacccaccucaccguccuc

SEQ ID NO: 16671 - RNA, 324 nt, Artificial Sequence
  derived and/or modified sequence opt2 from anti-HIV_V3_LightChain
uccuacgagcucacccagccccccuccgucuccgucucccccggccagaccgcccgcaucaccugcuccggcgacgcccuccccaacaaguacgccuucugguaccagcagaaguccggccaggcccccguccucgucaucuucgacgacaaccgccgccccgccggcauccccgagcgcuucuccggcucccgcuccggcacccucgccacccucaccaucuccggcgcccaggucgaggacgaggccgacuacuacugcuacuccaccgacaacgacggcaaguacuucgucuucggcuccggcaccauggucaccguccuc

SEQ ID NO: 16672 - RNA, 318 nt, Artificial Sequence
  derived and/or modified sequence opt2 from anti-HIV_V3_LightChain
uccuacgagcucacccagccccccuccgucuccgucucccccggccagaccgccuccaucaccugcuccggccacaagcucggcgacaaguacgccuccugguaccagcacaagcccggccagucccccguccucgucaucuacgaggacacccagcgccccuccggcauccccgagcgcaucuccggcuccaaguccggcaacaccgccacccucaccaucuccggcacccaggccauggacgaggccgacuacuacugccaggccugggacucccgcgccgccgucuucggcggcggcacccgccucaccguccuc

SEQ ID NO: 16673 - RNA, 327 nt, Artificial Sequence
  derived and/or modified sequence opt2 from anti-HIV_V3_LightChain
caguccgcccucacccagcccgccuccgucuccggcucccccggccaguccaucaccaucuccugcaccggcaucuccuccgacaucggcaccgacaacuacgucuccugguaccagcagcaccccggcaaggcccccaagcucaucaucuacgaggucuccaaccgccccuccggcaucucccaccgcuucuccggcuccaaguccggcaacaccgccucccucaucaucuccggccuccaggucgaggacgaggcccacuacuacugcaacuccuaccgcuccgacacccucgucuucggcggcggcaccaaggucaccguccuc

SEQ ID NO: 16674 - RNA, 333 nt, Artificial Sequence
  derived and/or modified sequence opt2 from anti-HIV_V3_LightChain
caguccguccucacccagccccccuccgccuccggcacccccggccagcgcgucaccaucuccugcuccggcuccuccuccaacaucggcuccaacaccgucaacugguaccagcaccuccccggcaccgcccccaagcuccucaucuacuccaacgaccagcgccccuccggcguccccgaccgcuucuccggcuccuccuccggcaccuccgccucccucgccaucuccggccuccaguccgaggacgaggccgacuacuacugcgccgccugggacgacucccucaacggccccuucgucuucggcaccggcaccaaggucaccguccuc

SEQ ID NO: 16675 - RNA, 318 nt, Artificial Sequence
  derived and/or modified sequence opt2 from anti-HIV_V3_LightChain
gacauccagaugacccagucccccuccucccucuccgccuccgucggcgaccgcaucaccaucaccugccgcaccucccaguccaucgacaaccaccucaacugguaccagcacaagcccggcaaggcccccaagcuccucaucuccgccgccucccgccuccaguccggcguccccucccgcuucaccggcuccggcuccggcaccgaguucacccucaccaucuccucccuccagcccgaggacuucgccgucuacuacugccagcaguccuacaucaccaucaccuucggccccggcaccaaggucgacaucaag

SEQ ID NO: 16676 - RNA, 321 nt, Artificial Sequence
  derived and/or modified sequence opt2 from anti-HIV_V3_LightChain
gagaucgucaugacccagucccccgccacccucuccgucucccccggcgagggcgucacccucuccugccgcgccucccaguccgucuccuccaacauccucugguaccagcagcgccccggccaggccccccgccuccuccucuacggcgccuccacccgcgccaccggcauccccgcccgcuucuccggcuccggcuccggcaccgaguucacccucaccaucaacuccaugcaguccgaggacuucgccaucuacuacugccagcaguaccacgacuggcucuggacccucggccagggcacccaggucgagaucaag

SEQ ID NO: 16677 - RNA, 327 nt, Artificial Sequence
  derived and/or modified sequence opt2 from anti-HIV_V3_LightChain
uccuacgagcucacccagccccccuccgucuccgucucccccggccagaccgccuccaucaccugcuccggcgacaagaugggcgagcgcuacaccuccugguaccagcagaagcccggccagucccccguccucgucauguccgagaacaucaagcgccccgccggcauccccgagcgcuucuccggcuccuccuccggcaacaccgccauccucaccaucuccggcacccaggccgucgacgaggccgacuacuacugccaggucugggacaccaccaccaccuccuacgucaucuucggcggcggcaccaagcucaccguccuc

SEQ ID NO: 16678 - RNA, 321 nt, Artificial Sequence
  derived and/or modified sequence opt2 from anti-HIV_V3_LightChain
gacauccagaugacccagucccccuccucccucuccgccuccgucggcgaccgcgucaccaucaccugccaggccucccaggacaucggcaacuaccucaacugguaccaccagaagcccggcaaggcccccaagcuccucaucuacgacgccuccaacgucgagaccggcgucgccucccgcuucuccggcuccggcuccggcaccgacuucacccucaccaucuccucccuccagcccgaggacaucggcaccuacuucugccagcaguacgagucccuccccugggccuucggcggcggcaccaaggucgagauccgc

SEQ ID NO: 16679 - RNA, 333 nt, Artificial Sequence
  derived and/or modified sequence opt2 from anti-HIV_V3_LightChain
aacuucaagcucacccagccccacuccgucuccgagucccccggcaagaccgucaccaucuccugcacccgcaccuccggcaccaucgccaccaacuacguccagugguuccagcagcgccccggcuccucccccaccaccaugaucuacgagaacgacaagcgccccuccggcguccccgaccgcuucuccggcuccaucgacaccuccuccaacuccgccucccucaccaucuccggccucaagaccgaggacgaggccgacuacuacugccaguccuacaacuccaccgacaucgucgucuucggcggcggcaccaagcucaccguccuc

SEQ ID NO: 16680 - RNA, 327 nt, Artificial Sequence
  derived and/or modified sequence opt2 from anti-HIV_V3_LightChain
caguccguccucacccagccccccuccgucuccgccgcccccggccagaaggucaccaucuccugcuccggcuccuccuccaacaucggcaacaacauggucuccugguaccagcagcaccccggcaccgcccccaagcuccucaucuacgagaacuccaagcgccccuccggcauccccgaccgcuucuccggcucccgcuccggcaccuccgccacccucggcaucaucggccuccagaccggcgacgaggccgaguacuacugcgccaccugggacggcucccuccgcaccgucuucggcggcggcaccaagcucaccguccuc

SEQ ID NO: 16681 - RNA, 324 nt, Artificial Sequence
  derived and/or modified sequence opt2 from anti-HIV_V3_LightChain
uccuacgagcucacccagccccccuccgucuccgucucccccggccagaccgcccgcaucaccugcuccggcgacgcccuccccaaccaguacggcuacugguaccagcagaagcccggccaggcccccguccucgucaucuucaaggacuccgagcgccccuccggcauccccgagcgcuucuccggcuccuccuccggcaccaccgucacccucaccaucuccggcguccaggccgaggacgaggccgacuacuacugccaguccgccgacuccuccggcaacuacgaggucuucggcggcggcaccaagcucaccguccuc

SEQ ID NO: 16682 - RNA, 330 nt, Artificial Sequence
  derived and/or modified sequence opt2 from anti-HIV_V3_LightChain
caguccguccucacccagccccccuccgucuccgaggccccccgccagcgcgucaccaucuccugcuccggcuccuccuccaacaucggcaacaacgccgucaacugguaccagcagguccccggcaaggcccccaagcuccucaucuacuacgacgaccuccuccccuccggcgucuccgaccgcuucuccggcuccaaguccggcuccuccgccucccucgccaucuccggccuccaguccgaggacgaggccgacuacuacugcgccgccugggacgacucccucaaggucuacgucuucggcaccggcaccuccgucaccguccuc

SEQ ID NO: 16683 - RNA, 333 nt, Artificial Sequence
  derived and/or modified sequence opt2 from anti-HIV_V3_LightChain
gacaucgucaugaaccaguccccccccucccucgccgucacccccggcgagcccgccuccaucuccugccgcgccucccagucccuccucuacuccgacggccacaacuaccucgacugguaccuccagaagcccggccaggccccccagcuccucaucuaccucggcuccacccgcgccuccggcguccccgaccgcuucuccggcuccggcuccggcaccgacuucacccucaagaucucccgcgucgaggccgaggacgucggcgucuacuacugcaugcagccccuccaguccuacaccuucggccagggcaccaagcucgagaucaag

SEQ ID NO: 16684 - RNA, 321 nt, Artificial Sequence
  derived and/or modified sequence opt2 from anti-HIV_V3_LightChain
gccuacgagcucacccagccccccuccgucuccgucucccccggccagaccgcccgcaucaccugcuccggcgacgcccuccccaaccaguacgccuacugguaccaccagcgccccggccaggcccccguccucgucauccacaaggacaccgagcgccccuccggcauccccgcccgcuucuccggcuccuccuccggcaccaccgucacccucaccaucuccgagguccaggccgaggacgagggcgacuacuacugccaguccgccgacaccuccgccuacgucgucuucggcggcggcaccaagcucaccguccuc

SEQ ID NO: 16685 - RNA, 330 nt, Artificial Sequence
  derived and/or modified sequence opt2 from anti-HIV_V3_LightChain
caguccguccucacccaggcccccuccuccuccggcacccccggccaguccgucaccaucuccugcuccggcuccuccuccaacauggagaucaacuacgucuacugguaccgccaguuccccggcaccgccccccagcuccucaucuacaacgacaaccagcgccccuccggcguccccgaccgcuucuccgccuccaaguccggcaccuccgccucccucgccaucggcggccuccgcuccgaggacgaggccgacuacuucugcgccgucuggcacggcgaccgcggcggccccgucuucggcggcggcaccaagcucaccguccuc

SEQ ID NO: 16686 - RNA, 327 nt, Artificial Sequence
  derived and/or modified sequence opt2 from anti-HIV_V3_LightChain
uccuacgagcucaagcagccccgcuccgucuccgucucccccggccagaccgcccgcaucaccugcuccggcgacgccaugcccaaccaguacgccuacugguaccagcagcgccccggccgcgcccccguccuccucaucuucaaggacaacgagcgcgccuccggcauccccgagcgcaucuccggcuccuccuccggcaccaccgccacccucaccaucaaccgcguccaggccgaggacgaggccgacuaccucugccaguccgccgacuccuccggcgccuuccccugggucuucggcggcggcaccacccucaccguccuc

SEQ ID NO: 16687 - RNA, 324 nt, Artificial Sequence
  derived and/or modified sequence opt2 from anti-HIV_V3_LightChain
uccuacgagcucacccagccccccuccgucuccgucucccccggccagaccgcccgcaucaccugcuccggcgacgcccuccccaaggaguacgccuacugguaccagcagaaguccggccaggcccccguccucgucaucuacgaggacacccgccgccccuccggcauccccgagcgcuucuccggcuccuccuccggcaccauggccacccucaccgucuccggcgcccacgucgacgacgaggccgacuacuacugcuacucccgcgacaccuccgccaaccagugggucuucggcggcggcaccaagcucaccguccuc

SEQ ID NO: 16688 - RNA, 318 nt, Artificial Sequence
  derived and/or modified sequence opt2 from anti-HIV_V3_LightChain
gagaucguccucacccagucccccgccacccucucccucucccccggcgagcgcgccacccucuccugccgcgccucccaguccaucuccaccuaccucggcugguaccagcagaagcccggccaggccccccgccuccucaucuacgacgccuccaaccgcgccaccggcauccccgcccgcuucuccggcuccggcuccggcaccgacuucacccucaccaucuccucccucgagcccgaggacuucgccgucuacuacugccagcagcgcuacaccuggaucaccuucggccagggcacccgccucgagaucaag

SEQ ID NO: 16689 - RNA, 327 nt, Artificial Sequence
  derived and/or modified sequence opt2 from anti-HIV_V3_LightChain
uccuacgagcucacccagccccccuccgucuccgucucccccggccagaccgcccgcaucaccugcuccggcgacgcccuccccaaccaguacgucuacugguaccagcagcgccccggccaggcccccgucgucguccucuacaaggacaccgagcgccccuccggcauccccgagcgcuucuccggcuccuccuccggcaccaccgucacccucaccaucuccggcguccaggccgaggacgaggccgacuacuacugccaguccgccgacaacuccggcgccuacccccucuucuucggcggcggcaccaagcucaccguccuc

SEQ ID NO: 16690 - RNA, 333 nt, Artificial Sequence
  derived and/or modified sequence opt2 from anti-HIV_V3_LightChain
caguccguccucacccagccccccuccgucuccgccgcccccggccagaaggucaccaucuccugcuccggcuccuccuccaacaucggcaacaacuacguccucugguaccagcaguuccccggcaccgcccccaagcuccucaucuacggcaacaacaagcgccccuccggcauccccgaccgcuucuccggcuccaaguccggcaccuccgccacccucggcaucaccggccuccagaccggcgacgaggccgacuacuucugcgccaccugggacuccggccucuccgccgacugggucuucggcggcggcaccaagcucaccguccuc

SEQ ID NO: 16691 - RNA, 321 nt, Artificial Sequence
  derived and/or modified sequence opt2 from anti-HIV_V3_LightChain
gacauccagaugacccagucccccuccucccucuccgccuccgucggcgaccgcgucaccaucaccugccgcgccucccaggagaucgacaacuaccucgccugguaccagcagcgccccggcaaggcccccaagucccucaucuacgccgccuccucccuccagggcggcgucccccccaaguucuccggcuccggcuccggcaccgaguucacccucaccaucuccucccuccaggccgaggacuucgccaccuacuacugccagcaguacaacgccuacccccucaccuucggccagggcacccgccucgacaucaac

SEQ ID NO: 16692 - RNA, 324 nt, Artificial Sequence
  derived and/or modified sequence opt2 from anti-HIV_V3_LightChain
uccuacgagcucacccagccccccucccucuccgucucccccggccagaccgccuccaucaccugcuccggcgacggccuccccaagcaguacggcuacugguaccagcagaagcccggccaggccccccuccucgucauccucaaggacaccgagcgccccuccggcauccccgagcgcuucuccggcuccuccuccggcaccaccgucacccucaccaucuccggcguccaggccgaggacgaggccgacuacuacugccaguccgucgacuccaccggcuccuacuacgucuucggccccggcaccaaggucaccguccuc

SEQ ID NO: 16693 - RNA, 324 nt, Artificial Sequence
  derived and/or modified sequence opt2 from anti-HIV_V3_LightChain
uccuacgagcucacccagccccccuccgucuccgucucccccggccagaccgcccgcaucaccugcuccggcgacguccuccccaagaaguacgccuacugguaccagcagaaguccggccucgcccccguccucgucaucuacgaggacaaccgccgccccuccggcauccccgagcgcuucuccggcuccuccuccggcaccauggccacccucaccaucuccggcgcccaggucgaggacgagggcgacuacuacugcuccuccaccgacuccuccggcgaccacuacgucuucggcaccggcaccaaggucaccguccuc

SEQ ID NO: 16694 - RNA, 321 nt, Artificial Sequence
  derived and/or modified sequence opt2 from anti-HIV_V3_LightChain
gccuacgagcucacccagccccccuccgucuccgucucccccggccagaccgcccgcaucaccugcuccgccgaggcccucuccaaccaguacgccuacugguaccgccagcgccccggccaggccccccuccucaucaucuacaaggacaccaagcgccccuccggcauccccgagcgcuucuccggcuccaccuccggcaccaccgucacccucaccaucuccggcguccaggccgaggacgaggccgacuacuacugccaguccgccgacuccuccggcgacuacgucuucggcggcggcaccaaggucaccguccuc

SEQ ID NO: 16695 - RNA, 333 nt, Artificial Sequence
  derived and/or modified sequence opt2 from anti-HIV_CD4bs_LightChain
cagcccguccucacccaguccuccuccgccuccgccucccucggcuccuccgucaagcucaccugcacccucggcuccggccacuccggcuccaucaucgccuggcaccagcagcagcccggcaaggccccccgcuaccucaugaagguccaguccuccggcuccuacaacaagggcuccggcguccccgaccgcuucuccggcuccuccuccggcgccgaccgcuaccucaccaucuccaaccuccaguucgaggacgagggcgacuacuacugcgagaccugggacaccaacaaguacgucuucggcaccggcaccaaggucaccguccuc

SEQ ID NO: 16696 - RNA, 324 nt, Artificial Sequence
  derived and/or modified sequence opt2 from anti-HIV_CD4bs_LightChain
gagcucguccucacccagucccccggcacccucucccucucccccggcgagcgcgccacccucuccugccgcgccucccaguccgucgccuccuacuaccucgccugguaccagcagaagcccggccaggccccccgccuccucaucuacggcgccuccucccgcgccaccggcauccccgaccgcuucuccggcuccgucuccggcaccgacuucacccucaccaucucccgccucgagcccgaggacuucgcccucuacuacugccagcaguacggcuccuccccccucuccuucggcggcggcaccaaggucgagauccgc

SEQ ID NO: 16697 - RNA, 333 nt, Artificial Sequence
  derived and/or modified sequence opt2 from anti-HIV_CD4bs_LightChain
caguccgcccucacccagccccccuccauguccggcucccccggccaguccaucaccaucuccugcaccggcuccggcuccgacgucggcucccacaacuucgucuccugguaccagcagcaccccgcccgcguccccaagcuccucaucuacgccgucggcaaccgccccuccggcgucuccgagcgcuucuccggcuccaaguccggcaacaccgccuaccucaccaucuccggccuccaggccgacgacgaggccgacuacuacugcuccucccacaccaccggcaccacccucgaggucuucggcggcggcacccgccucaccguccuc

SEQ ID NO: 16698 - RNA, 333 nt, Artificial Sequence
  derived and/or modified sequence opt2 from anti-HIV_CD4bs_LightChain
gacaucgucaugacccaguccccccucucccuccccgucacccccggcgagcccgccuccaucuccugccgcuccuccgagucccuccuccacuccaacggcuucaucuaccucgacugguaccuccagaagcccggccaguccccccagcuccucaucuaccucggcuccaagcgcgccuccggcgucuccgaccgcuucuccggcuccggcuccggcaccgccuucacccucaagaucucccgcgucgaggccgaggacgucggcgucuacuacugcaugcaggcccucgagucccgcaccuucggccagggcaccaagcucgagaucaag

SEQ ID NO: 16699 - RNA, 327 nt, Artificial Sequence
  derived and/or modified sequence opt2 from anti-HIV_CD4bs_LightChain
gagaucguccucacccagucccccggcacccucucccucucccccggcgagcgcgccacccucuccugccgcgccucccaguccgucuccuccuccuaccucgccugguaccagcagaagcccggccaguccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcacuacggcuccuccuccaucuucaccuucggccccggcaccaaggucgacauccgc

SEQ ID NO: 16700 - RNA, 330 nt, Artificial Sequence
  derived and/or modified sequence opt2 from anti-HIV_CD4bs_LightChain
aacuucaugcucacccagccccacuccgucuccggcucccccggcaagaccgucaccaucuccugcacccgcuccuccggcuccaucgccggcaacuacguccagugguaccagcagcgccccggcaccucccccaccaccgucaucuacgagaacgaccagcgcuccuccggcguccccgaccgcuucuccggcuccaucgacuccuccuccaacuccgccucccucaccaucuccggccucaagaccgaggacgaggccgacuacuacugccacuccuacgacgccaccaaccaggucuucggcggcggcaccaagcucaccguccuc

SEQ ID NO: 16701 - RNA, 333 nt, Artificial Sequence
  derived and/or modified sequence opt2 from anti-HIV_CD4bs_LightChain
gacgucgucgucacccaguccccccucucccuccccgucacccucggccagcccgccuccaucuccugccgcuccucccagucccucgucuacuccgacggcaccacccaccucaacugguaccaccagcgccccggccagcccccccgccgccucaucuaccgcgucuccaaccgcgacuccggcguccccgaccgcuucuccggcuccggcuccggcaccgacuucacccuccgcaucucccgcgucgaggccgaggacgucggccucuacuacugcaugcucgccacccaccccuucaccuucggccccggcaccaaggucgagaucaag

SEQ ID NO: 16702 - RNA, 336 nt, Artificial Sequence
  derived and/or modified sequence opt2 from anti-HIV_CD4bs_LightChain
caguccguccucacccagccccccuccgucuccggcgcccccggccagaccgucaccaucuccugcaccggcuccuccuccaacaucggccccuccuacgacguccagugguaccagcaguuccccggccgcgcccccaagcuccucaucuccggcaacaacaaccgcgccuccggcguccccgaccgcuucuccggcuccaaguccggcaccuccgccucccucgccaucaccggccuccaguccgaggacgaggccgacuacuacugccagaccuacgacuccucccucuccggccacgucgucuucggcggcggcacccgccucaccguccuc

SEQ ID NO: 16703 - RNA, 321 nt, Artificial Sequence
  derived and/or modified sequence opt2 from anti-HIV_CD4bs_LightChain
gacauccagaugacccagucccccuccacccucuccgccuccgucggcgaccgcgucaccaucaccugccgcgccuccgccuccaucuacaccuggcucgccugguaccagcagcgccccggcaaggcccccgagguccucaucuacaaggccuccacccucaaguccggcguccccucccgcuucuccggcuccggcuccggcaccgaguucacccucaccaucuccucccuccagcccggcgacuucgccaccuacuacugccagcaguacaccaccuacccccucaccuucggcggcggcaccaccgucgagaucaag

SEQ ID NO: 16704 - RNA, 330 nt, Artificial Sequence
  derived and/or modified sequence opt2 from anti-HIV_CD4bs_LightChain
caguccgcccucacccagcccgccuccgucuccggcucccccggccaguccaucaccaucuccugcaccggcaccuccaacgacaucggcaccuacaaccucgucuccugguaccagcaccaccccaacaaggcccccaaggucgucgucuacgagaacaacaagcgccccuccggcaucuccaaccgcuucuccggcuccaaguccggcaacaccgccucccucaccaucuccggccuccaggccgaggacgaggccgacuacuacugcugcuccuacgccggcuccuccaccugggucuucggcggcggcaccaagcucaccguccuc

SEQ ID NO: 16705 - RNA, 321 nt, Artificial Sequence
  derived and/or modified sequence opt2 from anti-HIV_V2_LightChain
gacauccagaugacccagucccccuccacccucuccgccuccgucggcgaccgcgucaccaucaccugccgcgccucccagaccaucuccuccuggcucgccugguaccagcagaaguccggcaccgcccccaagcuccucaucuacaaggccuccuccaucgucuccggcguccccucccgcuucuccggcuccggcuccggcaccgaguucacccucaccaucaccucccuccagcccgacgacuucgccaccuacuacugccagcaguacaacuccucccccgagaccuucggccagggcaccaaggucgagaucaag

SEQ ID NO: 16706 - RNA, 318 nt, Artificial Sequence
  derived and/or modified sequence opt2 from anti-HIV_V2_LightChain
gagaucguccucacccagucccccggcacccucucccucucccccggcgagcgcgccacccucuccugccgcgccucccaguccgucuccuccuaccucgccugguaccagcagaagcccggccaggccccccgccuccucaucuacgacgccuccucccgcgccaccggcauccccgaccgcuucuccggcuccggcuccggcaccgacuucacccucaccaucucccgccucgagcccgaggacuucgccgucuacuacugccagcacuacgccggcucccgcaccuucggccagggcaccaaggucgagaucaag

SEQ ID NO: 16707 - RNA, 333 nt, Artificial Sequence
  derived and/or modified sequence opt2 from anti-HIV_V2_LightChain
caguccguccucacccagccccccuccgucuccggcgcccccggccagcgcgucaccaucuccugcaccggcuccuccuccaacaucggcgcccacuacgacguccacugguaccagcagcuccccggcaccgcccccaagcuccucaucuacggcaacuccaaccgccccuccggcguccccgaccgcuucuccggcuccaaguccggcaccuccgccucccucgccaucaccggccuccaggccgaggacgaggccgacuacuacugccaguccuacgacuccucccucuccggcuacgucuucggcaccggcaccaaggucaccguccuc

SEQ ID NO: 16708 - RNA, 324 nt, Artificial Sequence
  derived and/or modified sequence opt2 from anti-HIV_V2_LightChain
gacaccgucaugacccagucccccgccacccucuccgucucccccggcgagcgcgucacccucuccugccgcgccucccagaucaucaacaccaaccucgccugguaccagaagcgccccggccaggccccccgccuccucaucuacgccgccuccgcccgcgccaccggcauccccgcccgcuucuccggcuccggcuccggcaccgaguucacccucaccaucuccggccuccaguccgaggacuccgccgucuacuacugccagcaguacaagcacuggccccccuacaccuucggccgcggcaccaagcucgagauccgc

SEQ ID NO: 16709 - RNA, 321 nt, Artificial Sequence
  derived and/or modified sequence opt2 from anti-HIV_V2_LightChain
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccucccgcgccaccggcauccccgaccgcuucuccggcuccggcuccggcaccgacuucacccucaccaucucccgccucgagcccgaggacuucgccgucuacuacugccagcaguacggcuccucccgcaccuucggccagggcaccaaggucgagaucaag

SEQ ID NO: 16710 - RNA, 321 nt, Artificial Sequence
  derived and/or modified sequence opt2 from anti-HIV_V2_LightChain
gacauccagaugacccagucccccuccucccucuccgccuccgucggcgaccgcgucaccaucaccugccgcgccucccaguccaucuccggcaaccucaacugguaccagcagaagcccggcaaggcccccaaccuccucaucuacggcgccuccucccuccaguccggcguccccucccgcuucuccggcuccggcuccggcaccgacuucacccucaccaucuccucccuccagcccgaggacuucgccaccuaccacugccagcagucccacuccaccuccuggaccuucggccagggcaccaaggucgucaucaag

SEQ ID NO: 16711 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaaccacuacaccuccugguaccagcagaagaccggccaggcccccguccuccucaucuaccccaagcacaaccgcucccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccgaggucaccggccuc

SEQ ID NO: 16712 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaaccacuacaccuccugguaccagcagaagaccggccaggcccccguccuccucaucuaccccaagcacaaccgcucccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaaggucaccgucguc

SEQ ID NO: 16713 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaacuacuacaccuccugguaccagcagaagcccggccaggcccccguccuccucaucuaccccaagcacaaccgcccccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaaggucaccggccuc

SEQ ID NO: 16714 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaacuacuacaccuccugguaccagcagaagcccggccaggcccccguccuccucaucuaccccaagcacaaccgcccccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggccgcggcaccaagcucaccgucguc

SEQ ID NO: 16715 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaaccacuacaccuccugguaccagcagaagaccggccaggcccccguccuccucaucuaccccaagcacaaccgcucccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaaggucaccguccuc

SEQ ID NO: 16716 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaacuacuacaccuccugguaccagcagaagccccgccaggcccccguccuccucaucuaccccaagcacaaccgcccccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaagcucaccguccuc

SEQ ID NO: 16717 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaacuacuacaccuccugguaccagcagaagcccggccaggcccccguccuccucaucuaccccaagcacaaccgcccccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaagcucaccguccuc

SEQ ID NO: 16718 - RNA, 327 nt, Artificial Sequence
  derived and/or modified sequence opt2 from anti-HIV_10E8
gccuccgagcucacccaggaccccaccgucuccgucgcccucggccagaccgucaccaucaccugccgcggcgacucccuccgcaaccacuacaccuccugguaccagcagaagaccggccaggcccccauccuccucaucuaccccaagcacaaccgcccccccggcaucuccgaccgcuucuccgccuccuccuccggcaacaccgccucccucaccaucaccggcgcccagaccgaggacgagggcgacuacuacugcuccucccgcgacaaguccggcucccgccucgucaccuucggcggcggcaccaagcucaccguccuc

SEQ ID NO: 16719 - RNA, 327 nt, Artificial Sequence
  derived and/or modified sequence opt2 from anti-HIV_10E8
uccuccgaccucacccaggaccccgccgucuccgucgcccucggccagaccguccgcaucaccugccagggcgacucccuccgccgcuacuacgccggcugguaccagcagaagcccggccaggcccccguccucgucgucuacggccgcgacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16720 - RNA, 327 nt, Artificial Sequence
  derived and/or modified sequence opt2 from anti-HIV_10E8
gccuccgagcucacccaggaccccgccgucuccgucgccuucgagaagaccgucaccaucaccugccagggcgacucccuccgcucccacuacgucuccugguaccagaagcgccccggccaggcccccguccucgucuucuacggcaagaacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccgucccc

SEQ ID NO: 16721 - RNA, 327 nt, Artificial Sequence
  derived and/or modified sequence opt2 from anti-HIV_10E8
gccuccgagcucacccaggaccccgccgucuccgucgcccucaagcagaccgucaccaucaccugccgcggcgacucccuccgcucccacuacgucuccugguaccagcagaagcccggccaggcccccguccucgucuucuacggcaagaacaaccgccccuccggcauccccgaccgcuucuccggcuccuccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16722 - RNA, 327 nt, Artificial Sequence
  derived and/or modified sequence opt2 from anti-HIV_10E8
uccuccgagcucacccaggaccccggcgucuccgucgcccucaagcagaccgucaccaucaccugccgcggcgacucccuccgcucccacuacgucuccugguaccagaagaagcccggccaggcccccguccucgucuucuacggcaagaacaucggccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16723 - RNA, 327 nt, Artificial Sequence
  derived and/or modified sequence opt2 from anti-HIV_10E8
gccuccgagcucacccaggaccccgccgucuccgucgcccucaagcagaccgucaccaucaccugccgcggcgacucccuccgcucccacuacgucuccugguaccagaagaagcccggccaggcccccguccucgucuucuacggcaagaacaaccgccccuccggcauccccgaccgcuucuccggcuccuccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16724 - RNA, 327 nt, Artificial Sequence
  derived and/or modified sequence opt2 from anti-HIV_10E8
gccuccgagcucacccaggaccccggcgucuccgucgcccucaagcagaccgucaccaucaccugccgcggcgacucccuccgcucccacuacgucuccugguaccagaagcgccccggccaggcccccguccucgucuucuacggcaagaacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16725 - RNA, 327 nt, Artificial Sequence
  derived and/or modified sequence opt2 from anti-HIV_10E8
gccuccgagcucacccaggaccccggcgucuccgucgcccucgagcagaccgucaccaucaccugccgcggcgacucccuccgcucccacuacgucuccugguaccagaagaagcccggccaggcccccguccucgucuucuacggcaagaacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16726 - RNA, 327 nt, Artificial Sequence
  derived and/or modified sequence opt2 from anti-HIV_10E8
gccuccgagcucacccaggaccccggcgucuccgucgcccucaagcagaccgucaccaucaccugccgcggcgacucccuccgcucccacuacgucuccugguaccagaagaagcccggccaggcccccguccucgucuucuacggcaagaacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16727 - RNA, 327 nt, Artificial Sequence
  derived and/or modified sequence opt2 from anti-HIV_10E8
uccuccgagcucacccaggaccccggcgucuccgucgcccucaagcagaccgucaccaucaccugccgcggcgacucccuccgcucccacuacgucuccugguaccagaagaagcccggccaggcccccguccucgucuucuacggcaagaacaaccgccccuccggcauccccgaccgcuucuccggcuccaccuccggcaacaccgccucccucaccaucgccggcgcccaggccgaggacgacgccgacuacuacugcuccucccgcgacaaguccggcucccgccucuccgucuucggcggcggcaccaagcucaccguccuc

SEQ ID NO: 16728 - RNA, 327 nt, Artificial Sequence
  derived and/or modified sequence opt2 from anti-HIV_10E8
uccuccgagcucacccaggagaccggcgucuccgucgcccucggccgcaccgucaccaucaccugccgcggcgacucccuccgcucccacuacgccuccugguaccaggagaagcccggccaggcccccaagcuccucuucuacggcaagaacaaccgccccuccggcauccccgaccgcuucuccggcuccgccuccggcaaccgcgccucccucaccaucuccggcgcccaggccgaggacgacgccgaguacuacugcuccucccgcgacaaguccggcucccgccucuccgucuucggcggcggcaccaagcucgccguccuc

SEQ ID NO: 16729 - RNA, 327 nt, Artificial Sequence
  derived and/or modified sequence opt2 from anti-HIV_10E8
uccuccgagcucacccaggagaccggcgucuccgucgcccucggccgcaccgucaccaucaccugccgcggcgacucccuccgcucccacuacgccuccugguaccagaagaagcccggccaggcccccaagcuccucuucuacggcaagaacaaccgccccuccggcauccccgaccgcuucuccggcuucgccuccggcaaccgcgccucccucaccaucuccggcgcccaggccgaggacgacgccgaguacuacugcuccucccgcgacaaguccggcucccgccucuccgucuucggcggcggcaccaagcucaccguccuc

SEQ ID NO: 16730 - RNA, 327 nt, Artificial Sequence
  derived and/or modified sequence opt2 from anti-HIV_10E8
uccuccgagcucacccaggagaccggcgucuccgucgcccucggccgcaccgucaccaucaccugccgcggcgacucccuccgcucccacuacgccuccugguaccagaagaagcccggccaggcccccaagcuccucuucuacggcaagaacaaccgccccuccggcauccccgaccgcuucuccggcuccgccuccggcaaccgcgccucccucaccaucuccggcgcccaggccgaggacgacgccgaguacaucugcuccucccgcgacaaguccggcucccgccucuccgucuucggcggcggcaccaagcucaccguccuc

SEQ ID NO: 16731 - RNA, 327 nt, Artificial Sequence
  derived and/or modified sequence opt2 from anti-HIV_10E8
uccuccgagcucacccaggagaccggcgucuccgucgcccucggccgcaccgucaccaucaccugccgcggcgacucccuccgcucccacuacgccuccugguaccagaagaagcccggccaggcccccaagcuccucuucuacggcaagaacaaccgccccuccggcauccccgaccgcuucuccggcuccgccuccggcaaccgcgccucccucaccaucuccggcgcccaggccgaggacgacgccgaguacuacugcuccucccgcgacaaguccggcucccgccucuccgucuucggcggcggcaccaagcucaccguccuc

SEQ ID NO: 16732 - RNA, 327 nt, Artificial Sequence
  derived and/or modified sequence opt2 from anti-HIV_10E8
uccuccgagcucacccaggagaccggcgucuccgucgcccucggccgcaccgucaccaucaccugccgcggcgacucccuccgcucccacuacgccuccugguaccagaagaagcccggccaggcccccauccuccucuucuacggcaagaacaaccgccccuccggcauccacgaccgcuucuccggcuccgccuccggcaaccgcgccucccucaccaucuccggcgcccaggccgaggacgacgccgaguacuacugcuccucccgcgacaaguccggcucccgccucuccgucuucggcggcggcaccaagcucaccguccuc

SEQ ID NO: 16733 - RNA, 393 nt, Artificial Sequence
  derived and/or modified sequence opt2 from anti-HIV_10E8
gagguccagcucgucgaguccggcggcgaccucgucaagcccggcggcucccuccgccucuccugcuccgccuccggcuucuccuucaagaacaccuggaugaccuggguccgccaggcccccggcaagggccucgagugggucggccgcaucaccggccccggcgagggcuggaccuccgacuacgccgccaccguccagggccgcuucaccaucucccgcaacaacaugaucgacaugcucuaccucgagaugaaccgccuccgcaccgacgacaccggccucuacuacugcguccacaccgagaaguacuacaacuucuggggcggcuacccccccggcgaggaguacuuccagcacuggggccgcggcacccucgucaucgucuccucc

SEQ ID NO: 16734 - RNA, 393 nt, Artificial Sequence
  derived and/or modified sequence opt2 from anti-HIV_10E8
gagauccgccucgucgaguccggcggcggccucgucaagcccggcggcucccuccgccucuccugcuccgccuccggcuucaacuucgacuccgccuggaugaccuggguccgccagccccccggcaagggccucgagugggucggccgcaucaccggccccggcgagggcugguccgucggcuacgccgaguccgucaagggccgcuucaucaucucccgcaucaacuccaucaacuuccucuaccucgagaugaacaaccuccgccccgaggacaccggcuccuacuucugcgcccacaccggcaagcacuacgacuucuggcgcggcuacccccccggcgaggaguacuuccaggacuggggccagggcacccaggucaucgucuccucc

SEQ ID NO: 16735 - RNA, 393 nt, Artificial Sequence
  derived and/or modified sequence opt2 from anti-HIV_10E8
gagauccgccucgucgaguccggcggcggccucgucaagcccggcggcucccuccgccucuccugcuccgccuccggcuucaacuucgacuccgccuggaugaccuggguccgccagccccccggcaagggccucgagugggucggccgcaucaccggccccggcgagggcugguccgucgacuacgccgaguccgucaagggccgcuucaucaucucccgcaucaacuccaucaacuuccucuaccucgagaugaacaaccuccgccccgaggacaccggcuccuacuucugcgcccacaccggcaagcacuacgacuucuggcgcggcuacccccccggcgaggaguacuuccaggacuggggccagggcacccaggucaucgucuccucc

SEQ ID NO: 16736 - RNA, 393 nt, Artificial Sequence
  derived and/or modified sequence opt2 from anti-HIV_10E8
gagguccgccucgucgaguccggcggccgccucguccgccccggcggcucccuccgccucuccugcuccgccuccggcuucaacuucgacaacgccuggaugaccuggguccgccagccccccggcaagggccucgagugggucggccgcaucaccggccccggcgagggcugguccgucgacuacgccgccuccgucaagggccgcuucaccaucucccgcaugaacuccaucaacuucuucuaccucgagaugaacaaccucaagaucgaggacaccggccucuacuucugcgcccgcaccggcaagcacuacgccuucuggggcggcuacccccccggcgaggaguaccucgaggacuggggccagggcacccucgucaucgucuccucc

SEQ ID NO: 16737 - RNA, 393 nt, Artificial Sequence
  derived and/or modified sequence opt2 from anti-HIV_10E8
gagguccgccucgucgaguccggcggcggccucgucaagcccggcggcucccuccgccucuccugcuccgccuccggcuucaacuucgacgacgccuggaugaccuggguccgccagccccccggcaagggccucgagugggucggccgcaucuccggccccggcgagggcugguccgucgacuacgccgaguccgucaagggccgcuucaccaucucccgccucaacuccaucaacuuccucuaccucgagaugaacaacguccgcaccgaggacaccggcuacuacuucugcgcccgcaccggcaagcacuacgacuucugguccggcuacccccccggcgaggaguacuuccaggacuggggccagggcacccucgucaucgucuccucc

SEQ ID NO: 16738 - RNA, 393 nt, Artificial Sequence
  derived and/or modified sequence opt2 from anti-HIV_10E8
gagguccgccucgccgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccagggcacccucgucaucguccccucc

SEQ ID NO: 16739 - RNA, 393 nt, Artificial Sequence
  derived and/or modified sequence opt2 from anti-HIV_10E8
gagguccgccucgucgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccagggcacccucgucaucguccccucc

SEQ ID NO: 16740 - RNA, 393 nt, Artificial Sequence
  derived and/or modified sequence opt2 from anti-HIV_10E8
gagguccgccucgucgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccagggcacccucgucaucgucuccucc

SEQ ID NO: 16741 - RNA, 393 nt, Artificial Sequence
  derived and/or modified sequence opt2 from anti-HIV_10E8
gagguccgccucgccgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccgcggcacccucgucaucgucuccucc

SEQ ID NO: 16742 - RNA, 393 nt, Artificial Sequence
  derived and/or modified sequence opt2 from anti-HIV_10E8
gagguccgccucgucgaguccggcggcggccucgucaagcccggcggcucccuccgccucuccugcuccgccuccggcuucgacuucgacaacgccuggaugaccuggguccgccagccccccggcaagggccucgagugggucggccgcaucaccggccccggcgagggcugguccgucgacuacgccgcccccgucgagggccgcuucaccaucucccgccucaacuccaucaacuuccucuaccucgagaugaacaaccuccgcauggaggacuccggccucuacuucugcgcccgcaccggcaaguacuacgacuucugguccggcuacccccccggcgaggaguacuuccaggacuggggccgcggcacccucgucaucgucuccucc

SEQ ID NO: 16743 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggccgcuccuccaacaucggcaacaacaacgucuucugguaccagcagcuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16744 - RNA, 336 nt, Artificial Sequence
  derived and/or modified sequence opt2 from anti-HIV-1_LightChain
caguccguccucacccagcccgccuccgucuccggcucccccggccaguccaucaccaucuccugcaccggcaccaaguccgacaucggcggcuacaaguacgucuccugguaccagcagcaccccggcaaggcccccaagauccucaucuacgacgucaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16745 - RNA, 321 nt, Artificial Sequence
  derived and/or modified sequence opt2 from anti-HIV-1_LightChain
caguccguccucacccagccccccuccgucuccgccgcccccggccagcgcgucaccaucuccugcuucggcucccgcuucuccuccgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16746 - RNA, 333 nt, Artificial Sequence
  derived and/or modified sequence opt2 from anti-HIV-1_LightChain
caguccguccucacccagccccccuccgccuccggcacccccggccagaccaucaccaucuccugcuccggcuccuccuccaacaucggcuccaacgacgucuacugguaccagcaccuccccggcaccacccccaaggucgucaucuacaagaacaaccgccgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16747 - RNA, 327 nt, Artificial Sequence
  derived and/or modified sequence opt2 from anti-HIV-1_LightChain
caguccguccucacccagccccccuccauguccgccgcccccggccagaaggucaccaucuccugcuccggcuccaccuccaucaucggcaacaacuacaucuccugguaccagcagcuccccggcaccgcccccaagcuccucaucuacgaggacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucacc

SEQ ID NO: 16748 - RNA, 333 nt, Artificial Sequence
  derived and/or modified sequence opt2 from anti-HIV-1_LightChain
caguccguccucacccagccccccuccgucuccgccgcccccggccucaaggucaccaucuccugcuccggcaacaccuccaacgucggcgacaacuucgucuccugguaccgcuaccuccccggcaccgcccccaagcuccucuccuacgaggacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16749 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcuccaacaccgucaacugguaccagcaguuccccggcaccgcccccaagcuccucaucuacgagaacaaccgccgccccuccggcguccccgcccgcuucuccggcuccaaguccggcaccuccgccacccucgccaucaccggccuccagaccggcgacgaggccgacuacuacugcgccaccugggacuccucccucuccgccggcggcgucuucggcaccggcaccaaggucaccguccuc

SEQ ID NO: 16750 - RNA, 318 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcacc

SEQ ID NO: 16751 - RNA, 288 nt, Artificial Sequence
  derived and/or modified sequence opt2 from anti-HIV-1_LightChain
ggccucucccccucccucugcuccggcuccuccuccaacaucggcaacaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16752 - RNA, 333 nt, Artificial Sequence
  derived and/or modified sequence opt2 from anti-HIV-1_LightChain
caguucguccucacccagccccccuccgucuccgccgcccccggccagcgcgucaccgucuccugcuccggcaccaccuccgacaucggcgagaacuacgucuccugguaccagaaguucuccgaggccgcccccaagcuccuccucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16753 - RNA, 327 nt, Artificial Sequence
  derived and/or modified sequence opt2 from anti-HIV-1_LightChain
caguccguccucacccagccccccuccgucuccgccgcccccggccagaaggucaccaucuccugcuccggcggcuccuccaacaucggcaacuacuacgucuccugguaccuccagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucacc

SEQ ID NO: 16754 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaacauguccaacaucggcgacaacgccgucuccugguaccgccagguccccgaggcccccccccagcuccucaucuucggcaacgacaagcgccccuccggcgucaccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16755 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggcuccuccuccaacaucggcgccggcuacgacguccacugguaccuccagcuccccggcaccgccccccgccuccucaucuacgacaacgacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16756 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccaccuccaacaucggcaacaacuucgucuccugguaccagcagcuccccggcaccgcccccaagcuccucuucuacgacaacuacaagcgccccuccggcauccccgaccgcuucuccggcuccaaguccggcaccuccgccacccucgccaucaccggccuccagaccggcgacgaggccgacuacuacugcgccaccugggacuccucccucuccgccggcggcgucuucggcaccggcaccaaggucaccguccuc

SEQ ID NO: 16757 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggcggcuccuccaacaucggcgccggcuacgacguccacugguaccagcaccuccccggcaccgccccccagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16758 - RNA, 333 nt, Artificial Sequence
  derived and/or modified sequence opt2 from anti-HIV-1_LightChain
caguccguccucacccagccccccucccucuccgccgcccccggccagcgcgucaccgucuccugcuccggcuccuccuccaacaucggcgacaacuacgucuccugguaccagcagcuccccggcgccgccccccgccuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16759 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggccgcuccuccaacaucggcaacuacuucgucuccugguaccagcaguuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16760 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcuccaacgccguccacugguuccgccagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcgccaccugggacuccucccucuccgccggcggcgucuucggcaccggcaccaaggucaccguccuc

SEQ ID NO: 16761 - RNA, 333 nt, Artificial Sequence
  derived and/or modified sequence opt2 from anti-HIV-1_LightChain
caguccguccucacccagccccccuccgucuccgccgccuccggccagaaggucaccaucuccugcuccggcuccuccuccaacaucggcaacaacuacgucuccugguaccaccagcuccccggcaccgcccccaagcuccucaucuacgacaccaacaagcgccccuccggcauccccgaccgcuucuccggcuccaccuccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16762 - RNA, 333 nt, Artificial Sequence
  derived and/or modified sequence opt2 from anti-HIV-1_LightChain
cagcccguccucacccagccccccuccgucuccgccgcccccggccagaccgucaccaucuccugcuccggcuccuucuccaacaucgagaccaacuacgucuccugguaccagcagcuccccggcaccgcccccaagcuccucaucuacgacaacaacaugcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16763 - RNA, 336 nt, Artificial Sequence
  derived and/or modified sequence opt2 from anti-HIV-1_LightChain
cagcccguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16764 - RNA, 333 nt, Artificial Sequence
  derived and/or modified sequence opt2 from anti-HIV-1_LightChain
caguccguccucacccagccccccucccucuccgccgcccccggccagcgcaucaccaucuccugcuccggcuccuccuccaacaucggcaacaacuacgucuccugguaccagcaguuccccggcaccgcccccaagcuccucaucuacgagaacaacaagcgccccuccggcauccccgaccgcuucuccgccuccaaguccggcaccuccgccacccucggcaucaccggccuccagaccggcgacgaggccaacuacuacugcggcaccuggcacuccucccucuccgccggcggcgucuucggcaccggcaccaaggucaccguccuc

SEQ ID NO: 16765 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuucggcucccgcuucaacgucggcaccuccuccgucuccugguaccagcagcuccccggcaccgcccccaagcuccucaucgacgccaacggcgagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16766 - RNA, 333 nt, Artificial Sequence
  derived and/or modified sequence opt2 from anti-HIV-1_LightChain
caguccguccucacccagccccccuccgucuccgccacccccggccagaaggucaccaucuccugcuccggcucccgcuccaacaucggcucccacuacgucuccugguaccagcaguuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16767 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcuccaaccacgucuacugguaccagcagcuccccggcaagacccccaagcuccucaucuaccgcaacaaccagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16768 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccgccaacaucggcaacaacuacgucuccugguaccagcaguuccccggcaccggcccccgccucaucaucuacgaguccaacaagcgccccuccggcaucuccgaccgcuucuccggcucccaguccgacgccgccgccacccucgacaucaccggccuccagaccggcgacgaggccgacuacuacugcggcaccugggacuccucccucuccgccggcggcgucuucggcaccggcacccgcgucaccguccuc

SEQ ID NO: 16769 - RNA, 336 nt, Artificial Sequence
  derived and/or modified sequence opt2 from anti-HIV-1_LightChain
caguccguccucacccagccccccuccgucuccggcgcccccggccagaccgucaccaucuccugcaccggcgacaccuccaacaucggcgccgacuaccgcguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16770 - RNA, 333 nt, Artificial Sequence
  derived and/or modified sequence opt2 from anti-HIV-1_LightChain
caguccguccucacccagccccccucccucuccgccgcccccggccagcgcgucaccgucuccugcuccggcuccuccuccaacaucggcaacaacuacgucuccugguaccagcagcuccccggcgccgcccccaagcuccucaucuacaacaacaacauccgccccuccggcauccccgagcgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16771 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcggcaacuacgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16772 - RNA, 333 nt, Artificial Sequence
  derived and/or modified sequence opt2 from anti-HIV-1_LightChain
cagucccuccucacccagccccccuccgucuccgccgcccccggccagaaggucaccaucuccugcuccggcuccuccuccaacaucggcaacaacuucgucuccugguaccagcagcuccccggcaccgcccccaagcuccucaucuacgagaacaacaugcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16773 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaccuccuccaacaucgccaacuacuacgucuccugguaccgccagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16774 - RNA, 333 nt, Artificial Sequence
  derived and/or modified sequence opt2 from anti-HIV-1_LightChain
cagcccguccucacccagccccccuccgucuccggcgcccccggccagcgcgucaccaucuccugcuccggcuccuccuccaacaucggcaacaacgacgucuccugguaccagcagguccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16775 - RNA, 333 nt, Artificial Sequence
  derived and/or modified sequence opt2 from anti-HIV-1_LightChain
cagcucguccucacccagccccccuccgucuccgccgcccccggccagcgcgucaccaucuccugcuucggcucccgcuucaacgucggcaccuccuccgucuccugguaccagcagcuccccggcaccgcccccaagcuccucaucgacgccaacggcgagcgccccuccggcauccccgaccgcuucuucggcuccgaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16776 - RNA, 333 nt, Artificial Sequence
  derived and/or modified sequence opt2 from anti-HIV-1_LightChain
uccuacgagcucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16777 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccaccuccaacaucggcaccuacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16778 - RNA, 336 nt, Artificial Sequence
  derived and/or modified sequence opt2 from anti-HIV-1_LightChain
caguccgcccucacccagcccgccuccgucuccgccucccccggccaguccaucgccaucuccugcaccggcaccuccuccgacgucggcuccuacaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16779 - RNA, 330 nt, Artificial Sequence
  derived and/or modified sequence opt2 from anti-HIV-1_LightChain
caguccguccucacccagccccccuccgucuccgccgcccccggccagcgcgucaccaucuccugcuccggcggcuccuccaacaucggcaacaaccacgucuccugguaccagcaccuccccggccgcgccccccagcuccucaucuacgacaccacccagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguc

SEQ ID NO: 16780 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcuccaaguacgucugcugguaccagcagcuccccggcaccgcccccaagcuccucaucuaccgcaacaaccagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16781 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcgacuccuccaccuucgagaacgacuacgucugcugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16782 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacggcaacuccaaccgccccuccggcguccccgaccgcuucuccggcuccaaguccggcaccuccgccucccucgccaucaccggccuccaggccgaggacgaggccgacuacuacugcggcaccugggacuccucccucuccgccggcggcgucuucggcaccggcaccaaggucaccguccuc

SEQ ID NO: 16783 - RNA, 333 nt, Artificial Sequence
  derived and/or modified sequence opt2 from anti-HIV-1_LightChain
caguccguccucacccagccccccuccgucuccgccgcccccggccagaccgucaccaucuccugcuccggcuccuccuccaacaucggcuccaacaccgucaacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16784 - RNA, 336 nt, Artificial Sequence
  derived and/or modified sequence opt2 from anti-HIV-1_LightChain
caguccguccucacccagccccccuccgucuccggcgcccccggccagcgcgucaccaucuucugcaccggcuccuccuccaacgucggcggcggcuacgacguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16785 - RNA, 333 nt, Artificial Sequence
  derived and/or modified sequence opt2 from anti-HIV-1_LightChain
caguccguccucacccagccccccuccgucuccgccgcccccggccagaaggucacccucuccugcuccggcuccuccuccaacaucggcaacaacuccgucuccugguaccagcaguuccccggcaccgcccccaagcuccucaucuacgacuccgacaagcgccccuccggcauccccgaccgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16786 - RNA, 333 nt, Artificial Sequence
  derived and/or modified sequence opt2 from anti-HIV-1_LightChain
caguccguccucacccagccccccuccgccuccggcacccccggccagaaggucaccaucuccugcuccggcuccuccucccagaucggcuccaacuccgucuacugguaccagcagcuccccggcaccacccccaagcuccucaucuacggcaacaaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16787 - RNA, 336 nt, Artificial Sequence
  derived and/or modified sequence opt2 from anti-HIV-1_LightChain
caguccgcccucacccagcccgccuccgucuccggcucccccggccaguccaucaccaucuccugcaccggcaccggcuccgacgucggcggcuacaaccacgucuccugguaccagcagcaccccggcaaggcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16788 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuccggcuccggcuccaacaucggcgaccgcuucgucuccugguaccagcaccuccccggcaccguccccaagcuccucaucuacgacaacgagcaccgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16789 - RNA, 333 nt, Artificial Sequence
  derived and/or modified sequence opt2 from anti-HIV-1_LightChain
caguccguccucacccagccccccuccgucuccgccgcccccggccagaagaucaccaucuccugcuccggcuccuccuccaacaucggcaaguccgucgucuccugguaccgccaguuccccggcaccgcccccaagcuccucaucuacgacaccuacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16790 - RNA, 333 nt, Artificial Sequence
  derived and/or modified sequence opt2 from anti-HIV-1_LightChain
cagcccguccucacccagccccccuccgccuccggcacccccggccagcgcgucaccaucuccugcuccggcuccuccuccaacaucggcggcaacaccgucaacugguaccagcaguuccccggcgccgccccccgccuccucaucuacgaggacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16791 - RNA, 333 nt, Artificial Sequence
  derived and/or modified sequence opt2 from anti-HIV-1_LightChain
aacuucaugcucacccagccccacuccgucuccgagucccccggcaagaccgucaccaucuccugcacccgcuccuccggcuccgucgccuccaacuacguccagugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16792 - RNA, 333 nt, Artificial Sequence
  derived and/or modified sequence opt2 from anti-HIV-1_LightChain
caguccaugcucacccagccccccuccgucuccgccgcccccggccagcgcgucaccgucuccugcuccggcuccuccuccaacaucggcucccacuucgucuccugguaccagcagcuccccggcaccgcccccaagcuccucaucuacgacaacuccaaccgccccuccgccauccccgaccgcuucuccggcuccaaguccggcaccuccgccacccucggcaucuccggccuccacaccggcgacgaggccgacuacuacugcgccaccugggacaacucccucuccaccggcggcgucuucggcaccggcaccaaggucaccguccuc

SEQ ID NO: 16793 - RNA, 333 nt, Artificial Sequence
  derived and/or modified sequence opt2 from anti-HIV-1_LightChain
caguccguccucacccagccccccuccgucuccgccgcccccggccagaaggucaucaucuccugcuccggcggcuccuccaacaucggcaacaacuucgucuccugguaccaccagcuccccggcaccgcccccaagcuccucaucuacgagaacaccaagcgccccuccaagauccccgcccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16794 - RNA, 315 nt, Artificial Sequence
  derived and/or modified sequence opt2 from anti-HIV-1_LightChain
cagucccuccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggc

SEQ ID NO: 16795 - RNA, 336 nt, Artificial Sequence
  derived and/or modified sequence opt2 from anti-HIV-1_LightChain
caguccgcccucacccagcccgccuccgucuccggcucccccggccaguccaucaccaucuccugcaccggcaccuccuccgacaucggcuccuacuccuucgucuccugguaccagcagcaccccggcaaggcccccaagcucaucaucuacgacgucaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16796 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggcaacuccuccaacaucggcgccggcuucgacguccacugguaccgccaccuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16797 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcggcuccuccaacaucggcaacuacuacgucuccugguaccuccagcuccccggcgccgcccccaagcuccucaucuacgacaccgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16798 - RNA, 333 nt, Artificial Sequence
  derived and/or modified sequence opt2 from anti-HIV-1_LightChain
caguccguccucacccgcccccccuccgucuccgccgcccccggccagaaggucaccaucuccugcuccggccgcuccuccaacaucggcaacaacuacgucuccugguaccagcagcuccccggcgccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16799 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaccaucuccaacaucggcgccaaccucgucuccugguaccgccagcuccccggcaccguccccaccguccucauccacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16800 - RNA, 327 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuucgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucacc

SEQ ID NO: 16801 - RNA, 333 nt, Artificial Sequence
  derived and/or modified sequence opt2 from anti-HIV-1_LightChain
caguccguccucacccagucccccuccgucuccgccgcccccggccagcgcgucaccaucuccugcuccggcggcuccuccaacaucggcuccaacgccgucuccugguaccagcagcuccccggcaccgcccccaagcuccucaucuacggcgacaccaugcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16802 - RNA, 333 nt, Artificial Sequence
  derived and/or modified sequence opt2 from anti-HIV-1_LightChain
caguccguccucacccagccccccuccgucuccgccgcccccggccagcaggucaccaucuccugcuccggcaccaccuccaacaucggcaccaacuacgucuccugguaccagcagaugccccccgccgcccccaagcuccucaucuacgacaacaagaagcgccccuccgacauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16803 - RNA, 333 nt, Artificial Sequence
  derived and/or modified sequence opt2 from anti-HIV-1_LightChain
caguccgucgucacccagucccccuccgccuccggcacccccggccagcgcgucaucaucuccugcuccggcuccuccuccaacaucggcaacaucuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16804 - RNA, 333 nt, Artificial Sequence
  derived and/or modified sequence opt2 from anti-HIV-1_LightChain
caguccguccucacccagccccccuccauguccgccgcccccggccagaaggucaccaucuccugcuccggcuccaccuccaucaucggcaacaacuacaucuccugguaccagcagcuccccggcaccgcccccaagcuccucaucuacgaggacaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16805 - RNA, 336 nt, Artificial Sequence
  derived and/or modified sequence opt2 from anti-HIV-1_LightChain
caguccgcccucacccagccccccuccgccuccggcucccgcggccaguccgucaucaucuccugcaccggcaccuccuccgacgucggcgucuacaaccucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16806 - RNA, 333 nt, Artificial Sequence
  derived and/or modified sequence opt2 from anti-HIV-1_LightChain
caguccguccucacccagccccccuccauguccgccgcccccggccaguccgucuccaucuccugcuccggcuccuccgacaacaucgagcgcaaccaggucaucuggcuccgccagguccccggcgccgcccccaccguccucaucaucuucaacaaccgccgccccuccggcguccccgaccgcuucuccggcucccgcuccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16807 - RNA, 333 nt, Artificial Sequence
  derived and/or modified sequence opt2 from anti-HIV-1_LightChain
caguccguccucacccagccccccuccgucuccgccgcccccggccagaccgucaccaucuccugcuccggcuccuucuccaacaucgagaccaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16808 - RNA, 333 nt, Artificial Sequence
  derived and/or modified sequence opt2 from anti-HIV-1_LightChain
cagucccuccucacccagccccccuccgucuccgccgcccccggccagaaggucaccaucuccugcuccggcuccuccuccaacaucggcuccaaguacgucugcugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16809 - RNA, 336 nt, Artificial Sequence
  derived and/or modified sequence opt2 from anti-HIV-1_LightChain
caguccgcccucacccagccccgcuccgucuccggcucccccggccaguccgucaccaucuccugcaccggcaccaccuccgacgucggcggcuacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16810 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcaccggcuucaccuccaacaucggccucaacuacgucuccugguaccagcagguccccggcaccacccccaagcucgucaucuucgagaacgaccgccgcuuccucggcauccccgaccgcuucuccggcuccaaguccggcgccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16811 - RNA, 333 nt, Artificial Sequence
  derived and/or modified sequence opt2 from anti-HIV-1_LightChain
caguccguccucgcccagccccccuccgucuccgccgcccccggccagaaggucaccaucuccugcuccggccgcaccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16812 - RNA, 333 nt, Artificial Sequence
  derived and/or modified sequence opt2 from anti-HIV-1_LightChain
caguccguccucacccagcccaccuccgucuccgccgcccccggccgcugggucaccgucuccugcuccggcacccgcuccaacaucggcgaccacuccgucuccugguuccagcaccuccccggcgccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16813 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcgacaacuacgucuccugguaccagcaguuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16814 - RNA, 333 nt, Artificial Sequence
  derived and/or modified sequence opt2 from anti-HIV-1_LightChain
caggcccuccucacccagccccccuccgucuccgccgcccccggccagaaggucaccaucuccugcuccggcuccuccuccaacaucggcaacaacuacgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16815 - RNA, 333 nt, Artificial Sequence
  derived and/or modified sequence opt2 from anti-HIV-1_LightChain
cagcucguccucacccagccccccuccgccuccggcacccccggccagcgcgucaccaucuccugcuccggcuccaccuccaacaucggcaccuacuacgucuacugguaccagcuccuccccggcaccacccccaagguccucaucuacgccaacgaccagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16816 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaccuccuccaacaucggcaacaacuucgucuccugguaccagcgccuccccggcaccgcccccaagcuccucaucuucgagaacgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16817 - RNA, 333 nt, Artificial Sequence
  derived and/or modified sequence opt2 from anti-HIV-1_LightChain
caguccguccucacccagucccccuccgucuccgccacccccggccagcgcgucaccaucuccugcuccggcaacaccuccaacaucggcaagaacuucgucuccugguaccagcaguuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16818 - RNA, 333 nt, Artificial Sequence
  derived and/or modified sequence opt2 from anti-HIV-1_LightChain
caguccguccucacccagccccccuccgucuccgccgcccccggccgcgaggucaucaucuccugcuccggcuccuccuccaacaucggcaacaaccacgucuccugguaccagcagcuccccggcaccgcccccaagguccucaucuacgaguccaacaagcgccacuccggcauccccgaccgcuucuccggcuccaaguccggcaccuccgccacccucgccaucaccggccuccagaccggcgacgaggccgacuacuacugcggcgccugggacuccucccucuccgccggcggcgucuucggcaccggcaccaaggucaccguccuc

SEQ ID NO: 16819 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcgacuccaccgucaacugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16820 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccaccuccaacaucggcaacaacuacgucuccugguaccagcagcuccccggcaccgcccccaagcuccucaucuacgagaacaaccgccagcccuccggcauccccgaccgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16821 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcuccaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgucuacuacugcggcaccugggacuccucccucaccgccggcggcgucuucggcuccggcaccaaggucaccguccuc

SEQ ID NO: 16822 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaucggcuccuccuccaacaucggcgccgacuaccgcguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16823 - RNA, 336 nt, Artificial Sequence
  derived and/or modified sequence opt2 from anti-HIV-1_LightChain
caguccguccucacccagccccccuccgucuccggcgcccccggccagcgcaucaccgucuccugcaccggcaccuccuccaacaucggcgcccccuacgacgucaacugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16824 - RNA, 333 nt, Artificial Sequence
  derived and/or modified sequence opt2 from anti-HIV-1_LightChain
caguccguccucacccagccccccgccauguccgccgcccccggccaguccgucaccaucuccugcuccggcuccgccuucaacaucgagcgccaccaggucaccuggcuccgccaccuccccggcaccgcccccaccuccgucaucaucaugaacaaccagcgccccuccggcguccccgaccgcuucuccggcucccgcuccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16825 - RNA, 333 nt, Artificial Sequence
  derived and/or modified sequence opt2 from anti-HIV-1_LightChain
caguccguccucgcccagccccccuccgccuccggcacccccggccagcgcgucaccaucuccugcuccggcuccgccuccaacaucggcuucaacuccgucaccugguaccagcagcuccccggcaccgcccccaccguccucaucuacggcaacgaccuccgccccuccggcauccccgaccgcuucuccggcuccaaguccggcaccuccgccacccucggcaucaccggccuccagaccggcgacgagggcgacuacuacugcggcaccugggaccgcucccucuccgccggcggcgucuucggcaccggcaccaaggucaccguccuc

SEQ ID NO: 16826 - RNA, 336 nt, Artificial Sequence
  derived and/or modified sequence opt2 from anti-HIV-1_LightChain
caguccgcccucacccagcccgccuccgucuccggcucccccggcgaguccaucaccaucuccugcaccggcacccgcuccgacaucggcaacuacgccuacgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16827 - RNA, 333 nt, Artificial Sequence
  derived and/or modified sequence opt2 from anti-HIV-1_LightChain
caguccguccucacccagccccccuccgucuccgccccccccggccagaaggucaccaucuccugcuccggcaccaccuccaacaucggcuccaacuacgucgccugguaccagcagcuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16828 - RNA, 333 nt, Artificial Sequence
  derived and/or modified sequence opt2 from anti-HIV-1_LightChain
caguccguccucacccagucccccuccgucuccggcacccccggccagcgcgucaccaucuucugcuccggcuccgacuccgacaucggcaucaacuccgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16829 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaacuccuccaacaucggcaacaacuacgucuccugguaccagcaccuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16830 - RNA, 333 nt, Artificial Sequence
  derived and/or modified sequence opt2 from anti-HIV-1_LightChain
cagucccuccucacccagccccccuccgucuccgccgcccccggccagaaggucaccaucuccugcuccggcggcaacuccgacaucggcaagaacuucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16831 - RNA, 333 nt, Artificial Sequence
  derived and/or modified sequence opt2 from anti-HIV-1_LightChain
caguccguccucacccagccccccuccgucuccgccgcccccggccagaaggucaucaucuccugcuccggcuccuccuccaacaucggcaagaacuacgucgccugguaccagcagcuccccggcaccgcccccaagcuccucgucuacgagaacaccaaccgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16832 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccauguccgacaucggccucaaccccgucuccugguaccgccagcuccccgaggcccccccccaccuccucaucuucgacaacgacgagcgccccuccggcaccgccggccgcuucuccgccuccaaguccggcaccuccgccacccucgacaucaccggccuccagaccggcgacgaggccgacuacuacugcggcaccugggacuccucccucuccgccggcggcgucuucggcaccggcaccaaggucaccguccuc

SEQ ID NO: 16833 - RNA, 336 nt, Artificial Sequence
  derived and/or modified sequence opt2 from anti-HIV-1_LightChain
caguccgcccucacccagcccgccuccgucuccggcucccccggccaguccaucaccaucuccugcaccggcaccuccuccgacgucggcuccuacaaccucgucuccugguaccagcaguaccccggccgcgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16834 - RNA, 333 nt, Artificial Sequence
  derived and/or modified sequence opt2 from anti-HIV-1_LightChain
cagucccuccucacccagccccccuccgucuccgccucccccggccagaaggucaccaucuccugcuccggcaccuccuccaacaucggcaacaacuacgucuccugguaccagcaguuccccggcaccgcccccaagcuccucaucuacgagaacaacaagcgcuccuccggcauccccgaccgcuucuccggcuccaaguccgacaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16835 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggccgccgcuccaacaucggcgccggcuacgacguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16836 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuccggcuccuccuccaacaucggcaacaacuucgucuccugguaccaguucuuccccggcaccgcccccaagcucgucaucuacgagaacgacaagcgccccuccggcacccccgaccgcuucuccggcuccaaguccggcaccuccgccacccucgccaucaucggccuccagaccggcgacgagggcgacuacuacugcggcaccugggacaacucccucuccaccggcggcgucuucggcaccggcaccaaggucaccguccuc

SEQ ID NO: 16837 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuccggcggcuccuccaacaucggcaacaaccacgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16838 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggccgcgacuucgucuccugguaccagcagguccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16839 - RNA, 336 nt, Artificial Sequence
  derived and/or modified sequence opt2 from anti-HIV-1_LightChain
cagaccgucgucacccagccccccuccgucuccggcgcccccggccagaccgccaccaucuccugcaccggcuccuccuccaacaucggcgccgacuacgacguccacugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16840 - RNA, 333 nt, Artificial Sequence
  derived and/or modified sequence opt2 from anti-HIV-1_LightChain
aacuucaugcucacccagccccccuccgccuccggcacccccggccagcgcgucaccaucuccugcuccggcuccuccuccaacaucggcuccaacuacgucuacugguaccagcagcuccccggcaccacccccaagcuccucaucuaccgcaacaaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16841 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccucccccaacaucggcaacaacuuccucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16842 - RNA, 333 nt, Artificial Sequence
  derived and/or modified sequence opt2 from anti-HIV-1_LightChain
caguccguccucacccagucccccuccgucuccgccgcccccggccagaaggucaccaucuccugcuccggcuccuccuccgacaucggcaacaacuucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16843 - RNA, 333 nt, Artificial Sequence
  derived and/or modified sequence opt2 from anti-HIV-1_LightChain
caguucuuccucacccagccccccucccucuccgccacccccggccagcgcgucuccaucuccugcuccggcggcggcuccaacaucgccaacaacgacgucuucugguuccagcaguuccccggcgccggcccccgccuccucaucuacgacaaccucaagcgccacuacggcacccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16844 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccggccccaacaucggcuccaacuccgucuccugguaccagcacuuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16845 - RNA, 333 nt, Artificial Sequence
  derived and/or modified sequence opt2 from anti-HIV-1_LightChain
caguccguccucacccagucccccuccgccuccggcacccccggccagcgcgucaccaucuccugcuccggcuccuccuccaacaucggcuccaacaccgucuccugguuccagcaccuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16846 - RNA, 333 nt, Artificial Sequence
  derived and/or modified sequence opt2 from anti-HIV-1_LightChain
caguccguccucacccagccccccuccgucuccggcgcccccggccagaacgucaucaucuccugcuccggcuccuccuccaacaucggcaagaacuacgucgccugguaccagcagcuccccggcaccgcccccaagaucgucaucuacgagaccaccaaccgccccuccggcauccccgcccgcuucuccggcuccaaguccggcaccuccgccacccucggcaucaccggccuccaggccggcgacgaggccgacuacuacugcggcaccugggacuccucccucaacgccggcggcgucuucggcaccggcaccaaggucaccguccuc

SEQ ID NO: 16847 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuuccucuccugguaccagcaccuccccggcaccgccccccgccuccucaucuacgacaacgaccagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16848 - RNA, 333 nt, Artificial Sequence
  derived and/or modified sequence opt2 from anti-HIV-1_LightChain
caguccguccucacccagccccccuccgccuccggcacccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16849 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcaccaccuccaacaucggcaaccacuacgucuccugguaccagcaguuccccggcaccgcccccaagcucaucaucuacgagaccgaccgccgccccuccggcauccccgcccgcuucuccggcuccaaguccggcaccuccgccacccucgccaucgccggccuccagaccggcgacgaggccgacuacuacugcggcaccugggacuccucccucuccaccggcggcgucuucggcaccggcaccaaggucaccguccuc

SEQ ID NO: 16850 - RNA, 333 nt, Artificial Sequence
  derived and/or modified sequence opt2 from anti-HIV-1_LightChain
cagcucguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16851 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuccggcggcuccuccaacaucggcaacaaccacgucuccugguaccagcaccuccccggccgcgccccccagcuccucaucuacgacaccacccagcgccccucccgcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16852 - RNA, 333 nt, Artificial Sequence
  derived and/or modified sequence opt2 from anti-HIV-1_LightChain
caguccguccucacccagccccccuccgucuccgccgcccccggccagaagaucaccaucuccugcuccggcucccgcuccaacaucggcaacaacuacgucuccugguaccagcaguuccccggcaccgcccccaagcuccucaucuacgacaacaaccagcgccccucccgcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16853 - RNA, 321 nt, Artificial Sequence
  derived and/or modified sequence opt2 from anti-HIV-1_LightChain
caguccguccucacccagccccccuccgucuccgccgcccccggccagcgcgucaccaucuccugcuucggcucccgcuucuccuccgucuccugguaccagcagcuccccggcaccgcccccaagcuccucaucuaccccaacggcgagcgccccuccggcauccccgaccgcuucuucggcuccgaguccggcaccuccgccacccucggcaucaccggccuccagaccggcgacgaggccgacuacuacugcgccaccugggacuccucccucuccgccggcggcgucuucggcaccggcaccaagcucaccguccuc

SEQ ID NO: 16854 - RNA, 333 nt, Artificial Sequence
  derived and/or modified sequence opt2 from anti-HIV-1_LightChain
caguccguccucacccagccccccucccucuccgccgcccccggccagaaggucaccaucuccugcuccggcuccucccucaacaucggcaaccacuacgucuccugguaccagcagguccccggcaccgcccccaagcuccucaucuacgaggacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16855 - RNA, 333 nt, Artificial Sequence
  derived and/or modified sequence opt2 from anti-HIV-1_LightChain
caguucguccucacccagccccccuccgucuccgccgcccccggccagaaggucaccgucuccugcuccggcaccaccuccgacaucggcgagaacuacgucuccugguaccagaaguuccccgaggccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16856 - RNA, 333 nt, Artificial Sequence
  derived and/or modified sequence opt2 from anti-HIV-1_LightChain
cucuccguccucacccagccccccuccgucuccgccgcccccggccagcaggucaccaucuccugcuccggcaccaccuccaacaucggcaccaacuacgucuccugguaccagcagaugccccccaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16857 - RNA, 336 nt, Artificial Sequence
  derived and/or modified sequence opt2 from anti-HIV-1_LightChain
caguccaugcucacccagccccccuccgucuccggcgcccccggccagcgcgucaccaucuccugcaccggcucccgcuccaacaucggcgccggcuacgacguccacugguaccuccagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16858 - RNA, 333 nt, Artificial Sequence
  derived and/or modified sequence opt2 from anti-HIV-1_LightChain
caguccguccucacccagccccccuccgucuccgccacccccggccagaaggucaccaucuccugcuccggcucccgcuccaacaucggcucccacuacgucuccugguaccagcaguuccccgaguccgcccccacccuccucaucuacgagaacgucgagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16859 - RNA, 333 nt, Artificial Sequence
  derived and/or modified sequence opt2 from anti-HIV-1_LightChain
caguucuuccucacccagccccccucccucuccgccacccccggccagcgcgucuccaucuccugcuccggcggcggcuccaacaucgccaacaacgacgucuucugguuccagcaguuccccggcgccggcccccgccuccucaucuacgacaaccucaagcgccacuacggcacccccgaccgcuucuccggcuccaaguccggcgccaccggcacccucgagaucaccgagguccagaccgccgacgaggccgacuacuacugcggcaccugggacuccucccucuccgccggcggcgucuucggcaccggcaccaaggucaccguccuc

SEQ ID NO: 16860 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcggcuccuccaacaucggcgacaacuccgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccaccggcggcgucuucggcaccggcaccaaggucaccguccuc

SEQ ID NO: 16861 - RNA, 333 nt, Artificial Sequence
  derived and/or modified sequence opt2 from anti-HIV-1_LightChain
caguccguccucacccagccccccuccgucuccgccgcccccggccagaccgucaccaucuccugcuccggcuccgccuccaacaucggccgcaacuccgucuccugguaccaguacguccccggcgccgcccccaagcgccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 16862 - RNA, 333 nt, Artificial Sequence
  derived and/or modified sequence opt2 from anti-HIV-1_LightChain
caguccguccucgcccagccccccuccgucuccgccgcccccggccagaaggucaccaucuccugcuccggccgcaccuccaacaucggcaacuacuucgucuccugguaccagcaguuccccggcaccgccccccgccuccucaucuacgacaacgaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16863 - RNA, 333 nt, Artificial Sequence
  derived and/or modified sequence opt2 from anti-HIV-1_LightChain
caguccgcccucacccagcccgccuccgucuccgccgcccccggccagaaggucaccaucuccugcuccggcuccuccuccaacaucggcaacaucuacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16864 - RNA, 333 nt, Artificial Sequence
  derived and/or modified sequence opt2 from anti-HIV-1_LightChain
caguccguccucacccagccccccuccgucuccgccacccccggccagcgcgucaccgucuccugcuccggcuccuccuccaacaucggcaaccacuacgucuccugguaccagcagguccccggcaccgcccccaagcuccucaucuacgacaacuccaaccgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16865 - RNA, 333 nt, Artificial Sequence
  derived and/or modified sequence opt2 from anti-HIV-1_LightChain
caguccguccucacccagccccccucccucuccgccgcccccggccagcgcgucaccgucuccugcuccggcuccuccuccaacaucggcgacaacuacgucuccugguaccagcagcuccccggcgccgccccccgccuccucaucuacgacaacuccauccgccccuccgccauccccgcccgcuucuccggcuccaaguccggcaccuccgccacccucgccaucaccggccuccagaccggcgacgaggccgacuacuacugcggcaccugggacuccucccucuccgccggcggcgucuucggcaccggcaccaaggucaccguccuc

SEQ ID NO: 16866 - RNA, 336 nt, Artificial Sequence
  derived and/or modified sequence opt2 from anti-HIV-1_LightChain
caguccgcccucacccagcccgccuccgucuccggcucccccggccaguccaucaccaucuccugcaccggcaccuccuccgacgucggcggcuacgacuacgucuccugguaccuccagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16867 - RNA, 333 nt, Artificial Sequence
  derived and/or modified sequence opt2 from anti-HIV-1_LightChain
caguccguccucacccagccccccuccgucuccgccgcccccggccagcgcgucaccgucuccugcuccggcuccuccuccaacaucggcaacaacuacgucuccugguaccagcaguuccccggcaccgcccccaagcucgucaucuacgacaccgacaagcgccccuccggcauccccgaccgcuucuccggcuccaaguccggcaccuccgccacccucggcaucaccggccuccagaccggcgacgaggccgacuacuacugcgccaccugggacuccucccucuccgccggcggcgucuucggcaccggcaccaaggucaccguccuc

SEQ ID NO: 16868 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggcaacuccuccaacaucggcgccggcuacgacguccacugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16869 - RNA, 333 nt, Artificial Sequence
  derived and/or modified sequence opt2 from anti-HIV-1_LightChain
caguccguccucacccagccccccuccgccuccggcacccccggccagcgcgucaccaucuccugcuccggcuccuccuccaacaucggcuccaacuacgucgacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16870 - RNA, 333 nt, Artificial Sequence
  derived and/or modified sequence opt2 from anti-HIV-1_LightChain
caguccguccucacccagccccccuccgucuccgccacccccggccagaccgucaccaucuccugcuccggcuccuccuccaacaucggcaacaacuaccucuccugguaccgccagcucccccgcaccgcccccaagcuccucaucuacgagaacaaccgccgccccuccggcguccccgcccgcuucuccggcuccaaguccggcaccuccgccacccucgccaucaccggccuccagaccggcgacgaggccgacuacuacugcggcaccugggacuccucccucuccgccggcggcgucuucggcaccggcaccaaggucaccguccuc

SEQ ID NO: 16871 - RNA, 321 nt, Artificial Sequence
  derived and/or modified sequence opt2 from anti-HIV-1_LightChain
caguccguccucacccagccccccuccgucuccgccgcccccggccagcgcgucaccaucuccugcuucggcucccgcuucuccuccgucuccugguaccagcagcuccccggcaccgcccccaagcuccucaucuaccccaacggcgagcgccccuccggcauccccgaccgcuucuucggcuccgaguccggcaccuccgccacccucggcaucaccgccguccagaccggcgacgaggccgacuacuacugcggcaccugggacgacucccucuccaccggcggcgucuucggcaccggcaccaaggucaccguccuc

SEQ ID NO: 16872 - RNA, 333 nt, Artificial Sequence
  derived and/or modified sequence opt2 from anti-HIV-1_LightChain
caguccguccucacccagccccccuccgucuccgccgcccccggccagaaggucacccucuccugcuccggcaccuccuccaacaucggcaacaacuacgucuccugguaccagcagguccccggcgccgcccccaagguccucaucuacgagaacgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16873 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccaacuccaacaucggcaacaacuacgucuccugguaccagcagcuccccggcaccgccaccaagcuccucaucuacgagaacgacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16874 - RNA, 333 nt, Artificial Sequence
  derived and/or modified sequence opt2 from anti-HIV-1_LightChain
caguccguccucacccagccccccucccucuccgccgcccccggccagcaggucuccaucuccugccucggccgcuccuccaacaucggcaccaacuacgucuccugguaccagcaguuccccggcaccgcccccaagcuccucaucuacgagaacaagaagcgccccuccgagauccccgaccgcuucuccggcuccaaguccggcaccuccgccacccucggcaucaccggccuccagcccggcgacgaggccgacuacuacugcggcaccugggacuccucccucuccgccggcggcgucuucggcaccggcaccaaggucaccguccuc

SEQ ID NO: 16875 - RNA, 336 nt, Artificial Sequence
  derived and/or modified sequence opt2 from anti-HIV-1_LightChain
caguccgcccucacccagccccccuccgccuccggcucccccggccaguccgucaccaucuccugcaccggcaccuccuccgacgucggcgccuacaacuccgucuccugguaccagcagcuccccggcaccgcccccaagcuccucaucuccgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16876 - RNA, 333 nt, Artificial Sequence
  derived and/or modified sequence opt2 from anti-HIV-1_LightChain
caguccgcccucacccagccccccuccgccuccggcucccccggccaguccgucaccaucuccugcuccggcggcuccuccaacaucggcaacaaccacgucuccugguaccagcaccuccccggccgcgccccccagcuccucaucuacgacaccacccagcgccccucccgcauccccgaccgcuucuccggcucccgcuccggcaccuccgccacccucgccaucaccggccuccagaccggcgacgaggccgucuacuacugcggcaccugggacaacucccucuccaccggcggcgucuucggcaccggcaccaaggucaccguccuc

SEQ ID NO: 16877 - RNA, 333 nt, Artificial Sequence
  derived and/or modified sequence opt2 from anti-HIV-1_LightChain
caguccguccucacccagccccccuccgucuccgccgcccccggccagcgcgucaccaucuccugcuccggcggcaccuccaacaucggcaacgaguacgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16878 - RNA, 333 nt, Artificial Sequence
  derived and/or modified sequence opt2 from anti-HIV-1_LightChain
caguccguccucacccagccccccuccgucuccgccgcccccggccagcgcgucaccgucuccugcuccggcuccuccuccaacaucggcaacaacuacgucuccugguaccagcagcuccccggcgccgcccccaagcuccucaucuacgacaccgacaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16879 - RNA, 333 nt, Artificial Sequence
  derived and/or modified sequence opt2 from anti-HIV-1_LightChain
cagucccuccucacccagccccccuccgucuccgccgcccccggccagaaggucaccaucuccugcuccggcggcaacuccgacaucggcaagaacuucgucuccugguaccagcagucccccggcgccgccccccgccuccucaucuacgagaacgaccgccgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16880 - RNA, 333 nt, Artificial Sequence
  derived and/or modified sequence opt2 from anti-HIV-1_LightChain
caguccguccucacccagccccccuccgucuccgccgcccccggccagaaggucaacaucuccugcuccggcuccuccuccaacaucggcaagaacuacgucuccugguaccagcagauccccggcaccgcccccaagguccucaucuacgagaacaacaagcgccccuccggcauccccgaccgcuucuccggcuccaaguccggcaccuccgccacccucggcaucgccggccuccagaccggcgacgaggccgacuacuacugcgccaccugggacuccucccucuccgccggcggcgucuucggcaccggcaccaaggucaccguccuc

SEQ ID NO: 16881 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaaccgccacgucuccugguaccagcagcuccccggcaccguccccaagcuccucaucuacgagaccaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16882 - RNA, 336 nt, Artificial Sequence
  derived and/or modified sequence opt2 from anti-HIV-1_LightChain
caguccguccucacccagccccccuccgucuccggcgcccccggccagcgcgucaccaucuccugcaccggcuccuccuccaacaucggcgccggcuacgacguccacugguaccagcagcuccccggcaccgcccccaagcuccucaucuucggccacgacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16883 - RNA, 333 nt, Artificial Sequence
  derived and/or modified sequence opt2 from anti-HIV-1_LightChain
caguccguccucacccagcuccccuccgccuccggccuccccggccagaccgucaccaucuccugcuccggcuccaccuccuccaucggcuccaaccacgucuacugguaccagcaggucgccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcgccaccugggacuccucccucuccgccggcggcgucuucggcaccggcaccaaggucaccguccuc

SEQ ID NO: 16884 - RNA, 333 nt, Artificial Sequence
  derived and/or modified sequence opt2 from anti-HIV-1_LightChain
caguccguccucacccagacccccuccgccuccggcgcccccggccagggcgucaccaucuccugcuccggcuccuccuccaacgucggccgcaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16885 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuacgucuccugguaccagcaguuccccggcaccgcccccaagcuccucaucuccgacaacaacaagcgccccuccggcauccccgaccgcuucuccgucuccaaguccggcaccuccgccacccucggcaucaccggccuccaggccggcgacgaggccgacuacuacugcggcaccugggacuccucccucuccgccggcggcgucuucggcaccggcaccaaggucaccguccuc

SEQ ID NO: 16886 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccaacuccaacaucggcaacaacuacgucaccugguaccagcaguuccccggcaccgcccccaagguccucaucuacgacaacucccgccgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 16887 - RNA, 333 nt, Artificial Sequence
  derived and/or modified sequence opt2 from anti-HIV-1_LightChain
caguccguccucacccagccccccuccgucuccggcgcccccggccagcgcgucaccaucuccugcuccggcuccuccuccaacaucggcaacaacuacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16888 - RNA, 333 nt, Artificial Sequence
  derived and/or modified sequence opt2 from anti-HIV-1_LightChain
caguccguccucacccagccccccuccgucuccgccgcccccggccagaccgucaccaucuccugcuccggcuccaccuccaacaucggccagaacuuccucuccugguuccagcacguccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16889 - RNA, 333 nt, Artificial Sequence
  derived and/or modified sequence opt2 from anti-HIV-1_LightChain
aacuucaugcucacccagccccccuccgccuccggcacccccggccagcgcgucaccaucuccugcuccggcuccuccuccaacaucggcuccaaguacgucuccugguaccagcagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16890 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuacgucuccugguaccagcuccuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaacucccucuccaccggcggcgucuucggcaccggcaccaaggucaccguccuc

SEQ ID NO: 16891 - RNA, 333 nt, Artificial Sequence
  derived and/or modified sequence opt2 from anti-HIV-1_LightChain
caguccguccucacccagccccccuccgucuccgccgcccccggccagaaggucaccaucuccugcuccggcuccuccuccaacaucggcaacaacuacgucuccugguaccagcagcuccccggcaccgcccccaagaucaucaucuacgacaacaacaagcgccccuccggcauccccgaccgcuucuccggcuccaaguccggcaccuccgccacccucggcaucaccggccuccagaccggcgacgaggccgacuacuacugcggcaccuggcacuccucccucuccgccggcggcgucuucggcaccggcaccaaggucaccguccuc

SEQ ID NO: 16892 - RNA, 333 nt, Artificial Sequence
  derived and/or modified sequence opt2 from anti-HIV-1_LightChain
caguccguccucacccagccccccuccgccuccgccacccccggccagcgcgucaccaucuccugcuccggcuccuccuccaacaucggcuccaagcacgucuacugguaccagaagcuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcggcaccugggaccgcucccucuccgccggcggcgucuucggcaccggcaccaaggucaccguccuc

SEQ ID NO: 16893 - RNA, 432 nt, Artificial Sequence
  derived and/or modified sequence opt2 from anti-HIV-1_HeavyChain
caggcccagcucgucgaguccggcggcggcgucguccagcccggccgcucccuccgccucuccugcgccgccuccggcuucaccuucuccuccuacggcauccacuggguccgccaggcccccggcaagggccucgagugggucgccgucauguccuccgacggcaccuacaaguacuacggcgacuccaugaagggccgcuucaccaucucccgcgacaacuccaagaacucccucuaccuccagaugaacucccuccgcgccgucgacaccgccgucuacuacugcgccaaggaccucggcgagggcgagaacgaggagugggccaccgacuacuacgacuucuccaucggcuaccccggccaggacccccgcggcgucgucggcaccuucgacaucuggggccagggcaccauggucaccgucuccucc

SEQ ID NO: 16894 - RNA, 426 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccgacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucuggggccagggcaccauggucaccgucuccucc

SEQ ID NO: 16895 - RNA, 432 nt, Artificial Sequence
  derived and/or modified sequence opt2 from anti-HIV-1_HeavyChain
cagguccagcucgucgaguccggcggcggcgucguccaguccggccgcucccuccgccucuccugcgccgccuccggcuucaccuucuccgccuacgcccuccacuggguccgccaggcccccggcaagggccucgagugggucgccgucaucuccuacgacggccgcgacaaggacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16896 - RNA, 432 nt, Artificial Sequence
  derived and/or modified sequence opt2 from anti-HIV-1_HeavyChain
cagguccagcucguccaguccggcggcggccucguccagcccggccgcucccuccgccucuccugcgucgccuccggcuuccgcuucuccuuccacggcaugcacuggguccgccaggcccccggcaagggccucgagugggucgccgucgucuccgacgacggcuccgaccagaaguacgucgacuccgucaagggccgccucaccaucucccgcgacaacuccaagaacaccgucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16897 - RNA, 432 nt, Artificial Sequence
  derived and/or modified sequence opt2 from anti-HIV-1_HeavyChain
gagguccaccucgucgaguccggcggcggcgucguccagcccggccgcucccuccgccucuccugcgccgccuccggcuucaccuucaacuccuacgccaugaucuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16898 - RNA, 432 nt, Artificial Sequence
  derived and/or modified sequence opt2 from anti-HIV-1_HeavyChain
cagguccagcucgucgaguccggcggcggcgucguccgccccggcggcucccuccgccucuccugcaccgccuccggcuuccacuucaacaaguacggcaugaacuggguccgccaggcccccggcaagggccucgcccucgucgccuucauccaguccggcgccuccuacaacuacuacgccgacuccgucaagggccgcuucaccaucucccgcgacaacuccaagaacacccucuaccuccagaugaacucccuccgcgccgaggacaccgccgucuacuacugcgccaaggaccucggcgacuccgagaacgaggagugggccuccgacuacuacgacuucggccgcgacuaccccggccaggacccccgcggcgucgucggcgccuucgacaucuggggccacggcaccauggucaccgucuccucc

SEQ ID NO: 16899 - RNA, 432 nt, Artificial Sequence
  derived and/or modified sequence opt2 from anti-HIV-1_HeavyChain
cagguccaccucgucgaguccggcggcggcgucguccagcccggcaagucccucaccaucuacugcgccgucuccgaguucacccucuccaacuacgccaugcacuggguccgccucacccccggcaagggccuccagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgucuucgacaucuggggccagggcaccauggucaccgucuccucc

SEQ ID NO: 16900 - RNA, 432 nt, Artificial Sequence
  derived and/or modified sequence opt2 from anti-HIV-1_HeavyChain
gagguccagcuccucgaguccggcggcggcgucguccagcccggccgcucccuccgccucuccugcgccgccuccggcuucaccuucuccaccuacgcccuccacuggguccgccaggcccccggcaagggccucgagugggucgccgucaucuccuacgacggcuccaccaaguucuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16901 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaucgaggaguggaccuccgacuacuacgacuucggccgcgacuaccccggccaggacccccgcggcgucuucggcaccuucgacaucuggggccacggcaccauggucaccgucuccucc

SEQ ID NO: 16902 - RNA, 432 nt, Artificial Sequence
  derived and/or modified sequence opt2 from anti-HIV-1_HeavyChain
gagguccagcucgucgaguccggcggcggcgucgucaagcccggcggcucccuccgccucuccugcgucgucuccggcuucaccuucuccaacgccuggauguccuggguccgccaggcccccggcaagggccucgagugggucgccgucaucuccgacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16903 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccaccuacggcaugcacuggguccgccaggcccccggcaagggccucgagugggucgccuucauccgcuacgacggccgcaacaagaacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucggcuaccccggccaggacccccgcggcgucgucggcaucuucgacaucuggggccagggcaccauggucaccgucuccucc

SEQ ID NO: 16904 - RNA, 432 nt, Artificial Sequence
  derived and/or modified sequence opt2 from anti-HIV-1_HeavyChain
cagguccaccucgucgaguccggcggcggcgucguccagcccggcggcucccuccgccucuccugcgccgccuccggcuucuccuucuccaucuacggcaugcacuggguccgccaggcccccggcaagggccucgagugggucaccuucacccgcuacgacggcuccaacaaguacuacaccgacuccgucaagggccgcuucaccaucucccgcgacaacuccaagaacacccucuaccuccagaugaacucccuccgcaccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16905 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcuccaacaaguacuacgccgaccccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgucuucgacaucuggggccagggcaccauggucaccgccuccucc

SEQ ID NO: 16906 - RNA, 432 nt, Artificial Sequence
  derived and/or modified sequence opt2 from anti-HIV-1_HeavyChain
gagaugcagcucgucgaguccggcggcggccucguccagcccggcggcucccuccgccucuccugcgccgccuccggcuucaccuucuccuccuacuggauguccuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16907 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccugcgccaugcacuggguccgccaggcccccggcaagggccucgagugggucgccgucaucuccuacgacggcaacaacaagcacuacgccgacuccgucaagggccgcuucaccaucucccgcgacaacuccaagaacacccucuaccuccagaugaacucccuccgcgccgaggacauggccgucuacuacugcgccaaggaccucggcgaguccgagaacgaggagugggccuccgacuacuacgacuucuggcgcgacuaccccggccaggacccccgcggcugggucggcaccuucgacaucuggggccagggcaccauggucaccgucuccucc

SEQ ID NO: 16908 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccaacuacggcaugcacuggguccgccaggcccccggcaagggccucgagugggucaccgucaucuccuccgacggcuccaagaaguacuacgccgacuccgucaagggccgcuucaccaucucccgcgacaacuccaagaacacccucuaccuccagaugaacggccuccgcgccgacgacaccgccgucuacuacugcgccaaggaccucggcgacuccgagaacgaggagugggccuccgacuacuacgacuucggccgcgacuaccccggccaggacccccgcggcgucgucggcgccuucgacaucuggggccacggcaccauggucaccgucuccucc

SEQ ID NO: 16909 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccaucggcuaccccggccaggacccccgcggcgucgucggcgccuucgacaucuggggccagggcaccauggucaccgucuccucc

SEQ ID NO: 16910 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuuccgcaacuacggcaugcacuggguccgccagucccccggcaagggccucgagugggucgccgucaucuccuacgacggcaagaucaucaacuacaucgacuucgucaagggccgcuucaccaucucccgcgagaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16911 - RNA, 432 nt, Artificial Sequence
  derived and/or modified sequence opt2 from anti-HIV-1_HeavyChain
gagguccagcuccucgaguccggcggcggccucguccagcccggccgcucccuccgccucuccugcgccgccuccggcuucaccuucuccuccuacgucaugcacuggguccgccaggcccccggcaagggccucgagugggucgccgucaucuccuacgacggcuccaacaagcacuacgccgacuccgucaagggccgcuucaccaucucccgcgacaacuccaagaacacccucuaccuccagaugaacucccuccgcgccgaggacaccgccgucuacuaccgcgccaaggaccucggcgaguccgagaacgaggagugggccuccgacuacuacgacuucggccgcgacuaccccggccaggacccccgcggcgucgucggcguccucuacaucuggggccagggcaccauggucaccgucuccucc

SEQ ID NO: 16912 - RNA, 432 nt, Artificial Sequence
  derived and/or modified sequence opt2 from anti-HIV-1_HeavyChain
gagguccagcucgucgaguccggcggcggccucgucaagcccggcggcucccuccgccucuccugcgccgccuccggcuucaccuucuccaccuacuccaugcacuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16913 - RNA, 432 nt, Artificial Sequence
  derived and/or modified sequence opt2 from anti-HIV-1_HeavyChain
cagguccagcucgucgacuccggcggcggcgucguccagcccggccgcucccuccgccucuucugcgccgucuccggcuucaccuucuccaccuacaccaugcacuggguccgccaggcccccggccgcggccucgagugggucgccgucaucuccuacgacggcuccaccaaguacuacgccgacuccguccagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16914 - RNA, 426 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgccccgaggacaccgccgucuacuacugcgccaaggaccucggcgaguccgagaacgaggagugggccuccgacuacuacgacuucggccgcgacuaccccggccaggacccccgcggcgucgucggcaccuucgacaucuggggccacggcaccauggucaccguc

SEQ ID NO: 16915 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucauguucucccgcuacggcaugcacuggguccgccaggcccccggcaagggccucgagugggucgccgucaucucccacgacggcuccaacaaguacuacgccgacuccgucaagggccgcuucaucaucucccgcgacaacuccaagaacacccucuaccuccagaugaacucccuccgcgccgacgacaccgccgucuacuacugcgccaaggaccucggcgaguccgagaacgaggagugggccuccgacuacuacgacuucuggaucggcuaccccggccaggacccccgcggcgucgucggcgccuucgacaucuggggccagggcaccauggucaccgucuccucc

SEQ ID NO: 16916 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccgccuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaagaacacccucuuccuccagaugaacucccuccgcgccgaggacauggccgucuacuacugcgccaaggaccucggcgaguccgagaacgaggagugggccuccgacuacuacgacuucuggcgcgacuaccccggccaggacccccgcggcugggucggcaccuucgacaucuggggccagggcaccauggucaccgucuccucc

SEQ ID NO: 16917 - RNA, 426 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccuacgacggcuccaacaaguacuacgucgacuccgucaagggccgcuucaccaucucccgcgacaacuccaagaacacccucuaccuccagaugaacucccuccgcgccgaggacaccgccgucuacgccaaggaccucggcgaguccgagaacgaggagugggccuccgacuacuacgacuucggcuccgacuaccccggccaggacccccgcggcgucgucggcaccuucgacaucuggucccagggcaccauggucaccgucuccucc

SEQ ID NO: 16918 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccaccuacggcaugcacuggguccgccaggcccccggcaagggccucgacugggucgccuucauccgcuacgacggcucccacaaguacuacgccgacuccgucaagggccgcuucaccaucucccgcgagaacuccaagaacacccucuaccuccagaugaacucccuccgccccgaggacaccgccgucuacuacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16919 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccggcgacuacuacgccgacuccgucaagggccgcuucaccaucucccgcgacaacuccaaguccacccucuaccuccagaugaacucccuccgccccgaggacaccgccgucuacuacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16920 - RNA, 432 nt, Artificial Sequence
  derived and/or modified sequence opt2 from anti-HIV-1_HeavyChain
cagguccaccucgucgaguccggcggcggcgucguccagcccggcggcucccuccgccucuccugcgccgccuccggcuucaccuucuccaccuacggcaugcaguggguccgccaggcccccggcaagggccucgagugggucgccuucaucaagaacgacggcaccaacgaguucuacggcgacuccgucaagggccgcuucaccaucucccgcgacaacuccaagaacaccgucucccuccacauggacucccuccgccccgaggacaccgcccucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16921 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgucgccuccggcuucaccuucuccuccuacggcaugcacuggguccgccaggcccccggcaagggccucgagugggucgccuucauccgcuacgacggccgcaacaaguacuacgccgacuccgucaagggccgcuucaccaucucccgcgacaaguccaagaacacccucugccuccagaugaacucccuccgcgucgaggacaccgccgucuacuacugcgccaaggaccucggcgacuccgagaacgaggagugggccuccgacuacuacgacuucggccgcgacuaccccggccaggacccccgcggcgucgucggcgccuucgacaucuggggccacggcaccauggucaccgucuccucc

SEQ ID NO: 16922 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuaccgcgacuccgucaagggccgcuucaccaucucccgcgacaacuccaagaacaccgucuaccuccagaugaacucccuccgcgccgaggacaccgccgucuacuacugcgccaaggaccucggcgaguccgaguccgaggagugggccuccgacuacuacgacuucggccgcgacuaccccggccaggacccccgcggcgucgucggcgcccucgacaucuggggccagggcaucauggucaccgucuccucc

SEQ ID NO: 16923 - RNA, 432 nt, Artificial Sequence
  derived and/or modified sequence opt2 from anti-HIV-1_HeavyChain
gagguccagcucgucgaguccggcggcggcaugguccagcccggccgcccccuccgccucuccugcgccgccuccggcuucaucuucuccggcuucggccuccacuggguccgccaggcccccggcaagggccucgagugggucgccuccaucuccuacgacggcggcaacaaguacuacgccgacuccguccgcggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16924 - RNA, 432 nt, Artificial Sequence
  derived and/or modified sequence opt2 from anti-HIV-1_HeavyChain
gagguccagcucgucgaguccggcggcggcgucguccgccccggcggcucccuccgccucuccugcgccgccuccggcuucaccuucaacgacuacggcauggccuggguccgccaggcccccggcaagggccucgagugggucgccgacaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgccuucgacaucuggggccagggcaccauggucaccgucuccucc

SEQ ID NO: 16925 - RNA, 429 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucgucuccuacgacgaguccaaguacuacgccgacuccgucaagggccgcuucaccaucucccgcgacaacuccaagaacacccucuaccuccagaugaacucccuccgcgccgaggacauggccgucuacuacugcgccaaggaccucggcgaguccgagaacgaggagugggccuccgacuacuacgaguucuggcgcgacuaccccggccaggacccccgcggcugggucggcaccuucgacaucuggggccagggcaccauggucaccgucuccucc

SEQ ID NO: 16926 - RNA, 432 nt, Artificial Sequence
  derived and/or modified sequence opt2 from anti-HIV-1_HeavyChain
cagguccagcucgucgagcccggccgcggcgucguccaccccggcggcucccuccgccucuccugcgucaccuccggcuucaccuucgagaacuuccccaugcacuggguccgccaggcccccggcaagggccucgagugggucgcccucaucuccuacgacggcuccgacaaguacuacuccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16927 - RNA, 432 nt, Artificial Sequence
  derived and/or modified sequence opt2 from anti-HIV-1_HeavyChain
caggcccagcucgucgaguccggcggcggcgucguccagcccggccgcucccuccgccucuccugcgccgccuccggcuucuccuucgccacccacgccaugcacuggguccgccgcucccccggcaagggccucgagugggucgccaccaucuccuacggcggcaagaacgaguacuacgccgacuccgucaagggccgcuucaccaucucccgcgagaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16928 - RNA, 432 nt, Artificial Sequence
  derived and/or modified sequence opt2 from anti-HIV-1_HeavyChain
gccguccagcucgucgaguccggcggcggccucgucaagcccggcggcucccuccgccucuccugcgccgccuccggcuucaccuucuucaacaccuggauguccuggguccgccagucccccggcaagggccucgagugggucgccgacaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgucuucgacaucuggggccagggcaccauggucaccgucuccucc

SEQ ID NO: 16929 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcgccgucgucggcgccuucgacaucuggggccagggcaccauggucaccgucuccucc

SEQ ID NO: 16930 - RNA, 432 nt, Artificial Sequence
  derived and/or modified sequence opt2 from anti-HIV-1_HeavyChain
cagguccgccucgucgaguccggcggccgcgucguccagcccggcggcucccuccgccucuccugcgucgccuccggcuucaccuucuccuccuacggcauccacuggguccgccaggcccccggcaagggccucgagugggucaccuucaucuggcacgacggccgcgacaccuacuacgccgacgccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuggaccggcuaccccggccaggacccccgcgccgucgucggcgccuucgacaucuggggccagggcaccauggucaccgucuccucc

SEQ ID NO: 16931 - RNA, 432 nt, Artificial Sequence
  derived and/or modified sequence opt2 from anti-HIV-1_HeavyChain
cagguccaccucgucgaguccggcggcggcgucguccagcccggccgcucccuccgcaucuacugcgccgucuccgaguucaccuuccgcaacuacgccaugcacuggguccgccucgcccccggcaagggccuccagugggucgccgucaucuccuacgacggcuccaacaaguacuacggcgacuccgucaagggccgcuucaccaucucccgcgacaacuccaagaacacccucuaccuccagauggacucccuccgcgccgaggacaccgccgucuacuacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16932 - RNA, 432 nt, Artificial Sequence
  derived and/or modified sequence opt2 from anti-HIV-1_HeavyChain
gagguccagcucgucgaguccggcggcggccucgucaagcccggcggcucccuccgccucuccugcgccgccuccggcuucaccuucuccgacgccuggauguccuggguccgccaggcccccggcaagggcauggagugggucgccgucaucuccuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccaucggcuaccccggccaggacccccgcggcgucgucggcgccuucgacaucuggggccagggcaccauggucaccgucuccucc

SEQ ID NO: 16933 - RNA, 432 nt, Artificial Sequence
  derived and/or modified sequence opt2 from anti-HIV-1_HeavyChain
gagguccaggucgucgaguccggcggcggccucgucaagcccggcggcucccuccgccucuccugcgaggccuccggcuucaccuucuccaacgccuggauguccuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaacgaggagugggccuccgacuacuacgacuucggccgcgacuaccccggccaggacccccgcggcgucgucggcaccuucgacaucuggggccacggcaccauggucaccgucuccucc

SEQ ID NO: 16934 - RNA, 432 nt, Artificial Sequence
  derived and/or modified sequence opt2 from anti-HIV-1_HeavyChain
cagguccagcucgucgaguccggcggcggcgucguccagcccggcggcucccuccgccucuccugcgccgccuccggcuucaccuucuccuccuacggcauccacuggguccgccaggcccccggcaagggccucgagugggucgccuucauccgcuccgacgccaccaacaaguacuacgccgacuccgucaagggccgcuucaccaucucccgcgagaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16935 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuacuacugcgccaaggaccucggcgaguccgagaacgaggagugggccuccgacuacuacgacuucggcuccgacuaccccggccaggacccccgcggcgucgucggcaccuucgacaucuggggccacggcaccauggucaccgucuccucc

SEQ ID NO: 16936 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccaacuacgccauggacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuggaccggcuaccccggccaggacccccgcgccgucgucggcgccuucgacaucuggggccagggcaccauggucaccgucuccucc

SEQ ID NO: 16937 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucgucuccuacgacgaguccaacaaguacuacgccggcuccgucaagggccgcuucaccaucucccgcgacaacuccaagaacacccucuaccuccagaugaacucccuccgcaccgaggacauggccgucuacuacugcgccaaggaccucggcgaguccgagaacgaggagugggccuccgacuacuacgacuucggccgcgaguaccccggccaggacccccgcggcugggucggcaccuucgacaucuggggccagggcaccauggucaccgucuccucc

SEQ ID NO: 16938 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucggcuaccccggccaggacccccgcggcgucgucggcaucuucgacaucuggggccagggcaccauggucaccgucuccucc

SEQ ID NO: 16939 - RNA, 432 nt, Artificial Sequence
  derived and/or modified sequence opt2 from anti-HIV-1_HeavyChain
cagguccagcucgucgaguccggcggcggcgucguccagcccggccgcucccuccgccucuccugcgccgccuccggcuucaccuucuccaccuccggcaugcacuggguccgccaggcccccggcaagggcauggagugggucgccgucaucuccuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccaucggcuaccccggccaggacccccgcggcgucgucggcgccuucgacaucuggggccagggcaccauggucaccgucuccucc

SEQ ID NO: 16940 - RNA, 363 nt, Artificial Sequence
  derived and/or modified sequence opt2 from anti-HIV_C38-VRC18.02_HeavyChain
cagguccgccucguccaguccggcaaccagguccgcaagcccggcgccuccguccgcaucuccugcgaggccuccggcuacaaguucaucgaccacuucauccacuggguccgccagguccccggccacggccucgaguggcucggcuggaucaacccccgcggcggcggcgucaacuacucccgcuccuuccagggcaagcucuccaugaccaugacccgcgacaacuucgaggagaccgccuaccucgaccucuccaagcucaaccccggcgacaccgccgucuacuucugcgcccgcggcuucgccggcuacgagugguccuucaucuggggccagggcacccucgucaucgucuccucc

SEQ ID NO: 16941 - RNA, 396 nt, Artificial Sequence
  derived and/or modified sequence opt2 from anti-HIV_44-VRC13.02_HeavyChain
cagguccagcucguccaguccggcaccgcccucaagucccccggcuccuccgccaagcucuccugcaccguccucggcgacgaguucggcaccuacuucaucuccuggauccgccaggcccccggccagggccucgagugggucggcggcaucgucccccacucccagcuccaguccuccgcccagaaguuccacggccgcaucaucaucuccgccggcgccggcgucaccccccccgucgucucccuccagcucaccaaccucaccuucgaggacaccggcaccuacuucugcgcccgcgagcgcggccgccaccgcgaccccaagaccggcgacgcccuccgcggccgcuacuucgacuucuggggccgcggcaccggccuccgcgucuccacc

SEQ ID NO: 16942 - RNA, 321 nt, Artificial Sequence
  derived and/or modified sequence opt2 from anti-HIV-1_LightChain
gacaucaagcucacccagucccccgccuuccucuccgccuccgucggcgagcgcgucaccuucaccugccgcgccucccaggacaucucccacgaccucgucugguuccagcagaaggccggccgcgcccccucccuccucauguucuacggcuccacccucgagcgcggcguccccccccgcuucuccggccgccgcuccggcaccgaguucaccgucaccaucgacucccuccagcccgaggacgucggcaccuacuacugccagcagcucuccgccuucccccucaccuucggcggcggcaccaccgucgacaucaag

SEQ ID NO: 16943 - RNA, 321 nt, Artificial Sequence
  derived and/or modified sequence opt2 from anti-HIV-1_LightChain
gacaucaagaugacccagucccccgccuuccucuccgccuccgucggcgagcgcgucaccuucaccugccgcgccucccaggacaucucccacgacgucgucugguuccagcagaaguccggcuccgcccccaagcuccucauguucuacggcuccacccucgagcgcggcguccccccccgcuucuccggccgccgcuccggcaccgaguucaccgucaccaucgacggccuccagcccgaggacgucggcaccuacuacugccagcagcucuccgccuucccccucaccuucggcggcggcaccaccgucgacaucaag

SEQ ID NO: 16944 - RNA, 321 nt, Artificial Sequence
  derived and/or modified sequence opt2 from anti-HIV-1_LightChain
gacaucaagcucacccagucccccgccuuccucuccgccuccgucggcgagcgcgucaccuucaccugccgcgccucccaggacauccgccacgagcucgucugguaccagcagaagcccggccgcggccccaagcuccucaucuacuacggcuccacccucgagggcggcguccccucccgcuucuccggccgccgcuccggcaccgaguucaccgucaccaucuccucccuccagcccgaggacgucggcaccuacuacugccagcagcucaacuccuucccccucaccuucggcggcggcaccaccgucgacauccgc

SEQ ID NO: 16945 - RNA, 321 nt, Artificial Sequence
  derived and/or modified sequence opt2 from anti-HIV-1_LightChain
gacauccagcucacccagucccccuccuuccucuccgccuccgucggcgaccgcgucuccaucaccugccgcgccucccagggcaucaagcacgagcucgccugguaccagcagaagcccggccgcgcccccucccuccucaucuacuacgccuccacccucgcccgcggcguccccucccgcuucuccgccuccugguccggcacccucuucacccucaccaucaacggccuccagcccgaggacuucgccaccuacuucugccagcagaugaacucccucccccucaccuucggcggcggcaccaagauggacguccgc

SEQ ID NO: 16946 - RNA, 321 nt, Artificial Sequence
  derived and/or modified sequence opt2 from anti-HIV-1_LightChain
gacauccagcucacccagucccccuccuuccucuccgccuccgucggcgacaaggucaccaucaccugccgcgccucccacggcguccgcaacgagcucgccugguaccagcagaagcccggcaaggcccccaaccuccucaucuacuacgccuccacccuccaguccggcguccccucccgcuucuccgccaccggcuccggcacccacuucacccucaccgucuccucccuccagcccgaggacuucgccaccuacuucugccagcacauguccuccuacccccucaccuucggcggcggcaccaaggucgagaucaag

SEQ ID NO: 16947 - RNA, 321 nt, Artificial Sequence
  derived and/or modified sequence opt2 from anti-HIV-1_LightChain
gacauccagcucacccagucccccuccuuccucuccgccuccgucggcgacaaggucaccuucaccugccgcgccucccagggcguccgcaacgagcucgccugguaccagcagaagcccggcaaggcccccaaccuccucaucuacuacgccuccacccuccaguccggcguccccucccgcuucuccgccaccggcuccggcacccacuucucccucaccgucuccucccuccagcccgaggacuucgccaccuacuucugccagcacauguccuccuacccccucaccuucggcggcggcaccaaggucgagaucaag

SEQ ID NO: 16948 - RNA, 321 nt, Artificial Sequence
  derived and/or modified sequence opt2 from anti-HIV-1_LightChain
gacauccagcucacccagucccccuccuuccucuccgccuccgucggcgacaaggucaccaucaccugccgcgccucccagggcguccgcaacgagcucgccugguaccagcagaagcccggcaaggcccccaaccuccucaucuacuacgccuccacccuccaguccggcguccccucccgcuucuccgccaccggcuccggcacccacuucacccucaccgucuccucccuccagcccgaggacuucgccaccuacuucugccagcacauguccuccuacccccucaccuucggcggcggcaccaaggucgagaucaag

SEQ ID NO: 16949 - RNA, 366 nt, Artificial Sequence
  derived and/or modified sequence opt2 from anti-HIV-1_HeavyChain
ucccaguaccucgcccagcccggcgccgaggucgccaagcccggcgccuccgucaaggucuccugcaagguccacggcgacaacuuccgcggccacuaccuccacuggguccgccaggcccccggccagggccuccaguggaucggcggcaucaaccccuucuccggcgaggccgccuacggcaagcgcuucgagggccgccuccgccucacccgcgacaccuccgucaacaccgccuacauggagcucgccaagcucacccccgacgacaccgccgucuacuucugcgcccgcgacaagaccuacaacgacgaguucaccgccauggacaucuggggccacggcaccaccgucaucgucuccucc

SEQ ID NO: 16950 - RNA, 366 nt, Artificial Sequence
  derived and/or modified sequence opt2 from anti-HIV-1_HeavyChain
ucccaguaccucgcccagcccggcgccgaggucgccaagcccugggccuccgucaaggucuccugccgcguccacggcgacaacuuccgcggcuucuaccuccacuggguccgccaggcccccggccagggccucgaguggaucggcggcaucaaccccuucuccggcgaggccgccuacggccgccgcuucgagggccgccuccgccucacccgcgacaccuccaucaacaccgccuacauggaggucaccaagcucaccuccgacgacaccgccgucuacuucugcgcccgcgacaagaccuacaacgacgaguucaccgccauggacaucuggggccagggcaccaccgucaucgucuccucc

SEQ ID NO: 16951 - RNA, 366 nt, Artificial Sequence
  derived and/or modified sequence opt2 from anti-HIV-1_HeavyChain
ucccaguaccucgcccaguccggcuccgaggucaagaagcccggcgccuccgucaaggucuccugccgccuccacggcgacaaguucggcgcccacuacauccacuggguccgccaggcccccggccagggccucgaguggcucggcuucuuccaccccggcaccggcgacgccgucuccgcccagaaguuccagggccgcaucucccucacccgcgacaccuccaucuccaccggcuaccucgagguccgccgccucuccuccgacgacaccgccgucuacuacugcgcccgcgacaagaccuacuccgacgaggccaccggcauggacaucuggggccagggcaccaccgucaucgucuccucc

SEQ ID NO: 16952 - RNA, 366 nt, Artificial Sequence
  derived and/or modified sequence opt2 from anti-HIV-1_HeavyChain
ucccucgagcucguccaguccggcaccgaggucaagaagcccggcgccuccgucaaggucuccugcaagcucuucggcgacaccaucaccuccggccccauccacuggguccgccaggcccccggccagggccucgaguggaugggcuggaccaacccccacuccggcgacaccgccaccgcccccaaguuccagggccgcgucuacaugaccaacgacaagaagaucaacaccgccuuccucgacgucacccgccucgccuccgacgacaccgccaucuacuucugcgcccgcgacauguacuacuccaacgaggccgucggcauggacgucuggggccagggcaccaccgucuccgucuccucc

SEQ ID NO: 16953 - RNA, 366 nt, Artificial Sequence
  derived and/or modified sequence opt2 from anti-HIV-1_HeavyChain
caggagguccucguccaguccggcgccgaggucaagaagcccggcgccuccgucaaggucuccugccgcgccuucggcuacaccuucaccgcccacgcccuccacuggguccgccaggcccccggccagggccucgaguggcucggcuggaucaacccccacuccggcgacaccaccaccucccagaaguuccagggccgcgucuacaugacccgcgacaaguccaucaacaccgccuaccucgaggucacccgccucaccuccgacgacaccgccaucuucuacugcgcccgcgacaaguacuacggcgacgaggccgucggcauggacgucuggggccagggcaccuccgucaccgucuccucc

SEQ ID NO: 16954 - RNA, 366 nt, Artificial Sequence
  derived and/or modified sequence opt2 from anti-HIV-1_HeavyChain
caggagguccucguccaguccggcgccgaggucaagaagcccggcgccuccgucaaggucuccugccgcgccuucggcuacaccuucaccggcaacgcccuccacuggguccgccaggcccccggccagggccucgaguggcucggcuggaucaacccccacuccggcgacaccaccaccucccagaaguuccagggccgcgucuacaugacccgcgacaaggccaucaacaccgccuaccucgacgucacccgccucaccuccgacgacaccgccaucuacuacugcgcccgcgacaaguacuacggcaacgaggccgucggcauggacgucuggggccagggcaccuccgucaccgucuccucc

SEQ ID NO: 16955 - RNA, 366 nt, Artificial Sequence
  derived and/or modified sequence opt2 from anti-HIV-1_HeavyChain
caggagguccucguccaguccggcgccgaggucaagaagcccggcgccuccgucaaggucuccugccgcgccuucggcuacaccuucaccggcaacgcccuccacuggguccgccaggcccccggccagggccucgaguggcucggcuggaucaacccccacuccggcgacaccaccaccucccagaaguuccagggccgcgucuacaugacccgcgacaaguccaucaacaccgccuuccucgacgucacccgccucaccuccgacgacaccggcaucuacuacugcgcccgcgacaaguacuacggcaacgaggccgucggcauggacgucuggggccagggcaccuccgucaccgucuccucc

SEQ ID NO: 16956 - RNA, 303 nt, Artificial Sequence
  derived and/or modified sequence opt2 from anti-HIV_45_LightChain
ucccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacaaccucaccaucuccaaccucgaguccggcgacuucggcgucuacuacugccagcaguacgaguucuucggccagggcaccaagguccaggucgacaucaag

SEQ ID NO: 16957 - RNA, 303 nt, Artificial Sequence
  derived and/or modified sequence opt2 from anti-HIV_45_LightChain
guccucacccagucccccggcacccucucccucucccccggcgagaccgccaccaucuccugccgcaccucccaguacggcucccucgccugguaccagcagcgccccggccaggccccccgccucgucaucuacuccggcuccacccgcgccgccggcauccccgaccgcuucuccggcucccgcuccggccccgacuacacccucaccaucuccaaccucgaguccggcgacuucggcgucuacuacugccagcaguacgaguucuucggccagggcaccaagguccagcaggacaacaag

SEQ ID NO: 16958 - RNA, 303 nt, Artificial Sequence
  derived and/or modified sequence opt2 from anti-HIV_45_LightChain
guccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacaaccucaccaucuccaaccucgaguccggcgacuucggcgucuacuacugccagcaguacgaguucuucggccagggcaccaagguccaggucgacaucaag

SEQ ID NO: 16959 - RNA, 363 nt, Artificial Sequence
  derived and/or modified sequence opt2 from anti-HIV_45_HeavyChain
cagguccgccucucccaguccggcggccagaugaagaagcccggcgaguccaugcgcaucuccugccgcgccuccggcuacgaguucaucgacugcacccucaacuggauccgccucgcccccggccgccgccccgaguggaugggcuggcucaagccccgcggcggcgccgucaacuacgcccgcgucuuccagggccgcgucaccaugacccgcgacgucuacuccgacaccgccuuccucgagcuccgcucccucaccgccgacgacaccgccgucuacuucugcacccgcggcaagaccgucgacuacaacugggacuucgagcacgucggccccggcacccccgucaccgucuccucc

SEQ ID NO: 16960 - RNA, 363 nt, Artificial Sequence
  derived and/or modified sequence opt2 from anti-HIV_45_HeavyChain
cagguccgccucucccaguccggcggccagaugaagaagcccggcgaguccaugcgcaucuccugccaggccuccggcuacgaguucaucgacugcacccucaacuggguccgccucgcccccggccgccgccccgaguggaugggcuggcucaagccccgcggcggcgccgucaacuacgcccgcaucuuccagggccgcgucaccaugacccgcgacgucuacuccgacaccgccuuccucgagcuccgcucccucaccgccgacgacaccgccgucuacuucugcacccgcggcaagaacugcgacuacaacugggacuucgagcacgucggccccggcuaccccgucaccgucuccccc

SEQ ID NO: 16961 - RNA, 375 nt, Artificial Sequence
  derived and/or modified sequence opt2 from anti-HIV_45_HeavyChain
cagguccgccucucccaguccggcggccagaugaagaagcccggcgacuccaugcgcaucuccugccgcgccuccggcuacgaguucaucaacugccccaucaacuggauccgccucgcccccggcaagcgccccgaguggaugggcuggaugaagccccgcggcggcgccgucuccuacgcccgccagcuccagggccgcgucaccaugacccgcgacauguacuccgagaccgccuuccucgagcuccgcucccucaccuccgacgacaccgccgucuacuucugcacccgcggcaaguacugcaccgcccgcgacuacuacaacugggacuucgagcacuggggccagggcacccccgucaccgucuccucc

SEQ ID NO: 16962 - RNA, 435 nt, Artificial Sequence
  derived and/or modified sequence opt2 from anti-HIV_cap256-206-252885_VR-Chain
caggagcagcucgucgaguccggcggcggcgucgucccccccggcuccucccucacccucuccugcgucgccucccgcuucaccuucuccgccuucggcaugcacuggguccgccaggcccccggcaagggccucgagugggucgccggcgucuccuucgucggcaucaagaaguacuacgccgacuccgucaagggccgcuucaccaucucccgcgacaacuccaagaacacccucuuccuccagaugaacggccuccgcggcgaggacaccggccucuacuacugcgucaaggacaugcgcuaccucgagugcgaggagugggccuccgacuacuacgacuucggcaagcccaaccagcccugccucgaccgccgcggcgucuccggcaucuccgccuucuggggccagggcaccaccgucaccgucuccucc

SEQ ID NO: 16963 - RNA, 438 nt, Artificial Sequence
  derived and/or modified sequence opt2 from anti-HIV_cap256-206-249183_VR-Chain
cagguccuccucgucgaguccggcggcggcgucgucgagcccggcaccucccucacccucuccugcgccgccucccgcuucaccuucuccaacuucggcaugcacuggguccgccagacccccggcggcggccucgagugggucgccuccaucuccaacgagggcaacaagaaguaccacgccgaguccgucuggggccgcuucaucaucucccgcgacaacuccaagaacaccgucuuccuccacauguccucccuccgccccgacgacuccgcccucuacuucugcguccgcgaccgccaggaggacgacugcgaggucuggugguccgacuacgaggccuucggccgcgagauccccugccgccaguaccgcggccagggccucgccggcaucuucgacaucuggggccgcggcaccauggucaccgucuccucc

SEQ ID NO: 16964 - RNA, 438 nt, Artificial Sequence
  derived and/or modified sequence opt2 from anti-HIV_cap256-206-220956_VR-Chain
cagaugaugcucgucgaguccggcggcgacgucgucgagcccggccgcucccucacccucuccugcgccaccucccaguucaccuucuccaacuacggcaugcacuggguccgccaggcccccggccgcggccucgagugggucgccuccaucuccaacgagggcaacaagaaguaccacgccgaguccgucuggggccgccucaucaucucccgcgacaacuccaagaacacccucuuccuccacauguccucccuccgcgccgacgacuccgcccucuacuucugcguccgcgaccgccaggaggacgagugcgaggaguggugguccaacuacuacgccuucggccgcggcggccccugccgcaaguaccgcggccagggccucgccggcaucuucgacgucuggggccgcggcaccauggucaccgucuccucc

SEQ ID NO: 16965 - RNA, 432 nt, Artificial Sequence
  derived and/or modified sequence opt2 from anti-HIV_cap256-206-220629_VR-Chain
caggagcagcucgucgaguccggcggcggcgucgucccccccggcaagucccucaagcucuccugcgucgccucccgcuucuccuucggcgccuucggcaugcacuggguccgccaggcccccggcaagggccucgagugggucgccggcaucuccuucgccggcaucaagaaguacuacggcgacuccgucaagggccgcuucuacaucucccgcgacaacucccagaacacccucuuccucgagaugaacggccuccgcggcgacgacaccgcccgcuacuacugcgucaaggaccuccgcgagcucgagugcgaggagugggccuccgacuacuacgacuucggcaagccccagcccugccucgacucccgcggcgucuccggcaucuccgccauguggggccccggcaccauggucaccgucuccucc

SEQ ID NO: 16966 - RNA, 381 nt, Artificial Sequence
  derived and/or modified sequence opt2 from anti-HIV_cap256-206-200599_VR-Chain
caggagaagcucgucgaguccggcggcggcgccguccagcccggcggcucccuccgccucuccugcgucgccuccggcuucaccuucaacggcuucggcaugcacuggguccgccaggcccccggcaagggccucgagugggucgccaccaucuccuucuccggcgucuacaucucccgcgagaacuccaagaacacccucuaccuccagaugaacggccuccgcggcgaggacaccgcccucuacuacugcgccaaggaccuccgcuaccucgagugcggcgagugguccaccuacuacccccagcccugccucgacacccgcggcgucuccggcaucuccaacgucuggggccccggcacccgcgucaccgucuccucc

SEQ ID NO: 16967 - RNA, 432 nt, Artificial Sequence
  derived and/or modified sequence opt2 from anti-HIV_cap256-206-186347_VR-Chain
caggagcuccucgucgaguccggcggcggcgucgucccccccggcaagucccucaccaucuccugcgucgccucccgcuucaccuucuccgccuucggcaugcacuggguccgccaggcccccggcaagggccuccagugggucgccuccaucuccuucgccggcaccaagaaguacuacgccgacuucgucaagggccgcuucaccaucucccgcgacaacuccaagaacaccaucuuccuccagaugaacggccuccgcggcgaggacaccgcccucuaccacugcgucaaggacaugcgccagcucgagugcgaggaguggaccuccgacuacuacgacuucggccgcccccagcccugcaucgaccgccgcggcgucuccggcaucuccgccauguggggccccggcaccauggucaccgucuccucc

SEQ ID NO: 16968 - RNA, 438 nt, Artificial Sequence
  derived and/or modified sequence opt2 from anti-HIV_cap256-206-186226_VR-Chain
cagaugcuccucgucgaguccggcggcggcgucgucgagcccggccgcucccucacccucuccugcgccaccucccaguucaccuucuccaacuacggcaugcacuggguccgccagacccccggcaccggccucgagugggucgccuccaucuccaacgagggcaacaagaaguaccacggcgaggccgucuggggccgcuucaucaucucccgcgacaacuccaagaagacccucuuccuccacauguccaaccuccgcgccgacgacuccggccucuacuucugcguccgcgaccgccaggaggacgagugcgaggaguggugguccgacuacuacuccuucggccgcggcggccccugccgcaaguaccacggccagggccucgccggcaucuucgacaucuggggccgcggcacccucgucaccgucuccucc

SEQ ID NO: 16969 - RNA, 435 nt, Artificial Sequence
  derived and/or modified sequence opt2 from anti-HIV_cap256-206-179686_VR-Chain
caggagcagcucgucgaguccggcggcggcgucgucccccccuggaagucccucacccucuccugcgaggccucccgcuucaccuucuccgccuucggcaugcacuggguccgccaggcccccggcaagggccucgagugggucgccggcaucuccuucgccggcaucaagaaguacuacgccgacuccgucaagggccgcuucuucaucucccgcgacaacuccaagaaccgcguccuccucgagaugaacggccuccgccgcgaggacaccgcccgcuacuucugcgucaaggaccuccgcgagcucgagugcgaggagugggccuccgacuacuacgacuucggcaagcccaaccagcccugccucgaccgccgcggcgucuccggcaucuccgccauguggggccagggcaccauggucaccgucuccucc

SEQ ID NO: 16970 - RNA, 417 nt, Artificial Sequence
  derived and/or modified sequence opt2 from anti-HIV_cap256-206-173707_VR-Chain
caggagaagcucgucgaguccggcggcggcgccguccagcccggcggcucccuccgccucuccugcgucgccuccggcuucaccuucaagggcuucggcaugcacuggguccgccaggcccccggcaagggccucgagugggucgccaccaucuccuucuccggcgucaagaaguacuacggcaacuccgccaagggccgcuucuucaucucccgcgacaaccucaagaacaccgucuaccucgagaugaacggccuccgcggcgaggacaccgcccucuacuacugcgccaaggaccuccgcuaccucgagugcggcgagugguccaccuacuacccccagcccugccucgacacccgcggcgucuccggcaucuccaacgucuggggccccggcaccaaggucaccgucuccucc

SEQ ID NO: 16971 - RNA, 432 nt, Artificial Sequence
  derived and/or modified sequence opt2 from anti-HIV_cap256-206-173339_VR-Chain
caggagcuccucgucgaguccggcggcggcgucgucccccccggcaagucccucaagcucuccugcgucgccucccgcuucaccuucggcgccuucggcaugcacuggguccgccaggcccccggcaagggccucgagugggucgccggcaucuccuucgccggcaccaagaacuacuacgccgacuccgucaagggccgcuucaccaucucccgcgacaaccccaagaacacccucuuccuccagaugaacggccuccgcggcgacgacaccggccucuacuacugcgucaaggacaugcgcgagcucgagugcgagcucuggaccuccgacuacuacgacuucggccgcccccagcccugcaucgaccagcgcggcgucuccggcaucuccgccauguggggccagggcaccauggucaccaucuccucc

SEQ ID NO: 16972 - RNA, 438 nt, Artificial Sequence
  derived and/or modified sequence opt2 from anti-HIV_cap256-206-172689_VR-Chain
cagaugaugcucgucgaguccggcggcggcgucgucgagcccggccgcucccucacccucuccugcgccaccucccacuucaccuucuccaacuacggcaugcacuggguccgccaggcccccggcggccgccucgagugggucgccuccaucuccaacgccggcaacaagaaguaccacggcgacuccgucuggggccgccucaucaucucccgcgacaacuccaagaacacccucuuccuccacauguccucccuccgcgucgacgacuccgcccucuacuucugcguccgcgaccgccaggaggacgagugcgaggaguggugguccgacuacuacgccuucggccgcggcggccccugccgcaaguaccgcggccagggccucgccggcaucuucgacaucuggggccgcggcaccauggucaccgucuccucc

SEQ ID NO: 16973 - RNA, 432 nt, Artificial Sequence
  derived and/or modified sequence opt2 from anti-HIV_cap256-206-162744_VR-Chain
caggagaagcucgucgaguccggcggcggcgucgucccccccggcaagucccuccgccucuccugcgucgccuccggcuucaccuucuccgccuucggcaugcacuggguccgccaggcccccggcaagggccucgagugggucgccggcaucuccuucgccggcaucaagaacuacuacgccgacuccgucaagggccgcuucaccaucucccgcgacaacuccaagaacucccucuuccuccagaugaacggccuccgcggcgacgacaccgcccgcuacuacugcgucaaggacaugcgcgagcucgagugcgaggaguggaccuccgacuacuacgacuucggcaagccccagcccugcaucgaccgccgcggcgucuccggcaucuccgccauguggggccagggcaccauggucaccaucuccucc

SEQ ID NO: 16974 - RNA, 438 nt, Artificial Sequence
  derived and/or modified sequence opt2 from anti-HIV_cap256-206-146057_VR-Chain
cagaugcagcucgucgaguccggcggcggcgucguccagcccggcaccucccucacccucuccugcgucgccucccaguucaccuucuccaacuacggcaugcacuggauccgccaggcccccggccagggccucgagugggucgccuccaucuccaacgacggcggcaagcgcuaccacggcgacgccgucugggcccgcuucaucaucucccgcgacaacuccaagaacaccgucuuccuccagaugaccucccuccgcgccgaggacaccgcccgcuacuucugcguccgcgaccgccaggaggacgagugccucgaguggugguccgacuacuacaacuucggccgccagcuccccugcgccaaguuccgcggccucggccucgccggcgucuucgacaucuggggccacggcaccauggucaccgucuccucc

SEQ ID NO: 16975 - RNA, 435 nt, Artificial Sequence
  derived and/or modified sequence opt2 from anti-HIV_cap256-206-139519_VR-Chain
caggagcagcucgucgaguccggcggcggcgucgucccccccggcaccucccuccgccucuccugcgucgccucccgcuucuccuucggcuccuucggcaugcacuggguccgccaggcccccggcaagggccucgagugggucgccggcaucuccuucgucggcaucaagaaguacuacggcgacuccgucaagggccgcuucuucaucucccgcgacaacuccaagaacacccucuuccucgagaugaacggccuccgcggcgaggacaccgcccgcuacuacugcgucaaggacaugcgcgagcucgagugcgaggagugggccuccgacuacuacgacuucggcaagcccaaccagcccugccucgaccgccgcggcgucuccggcaucuccgccauguggggccccggcaccaugcucaccgucuccucc

SEQ ID NO: 16976 - RNA, 432 nt, Artificial Sequence
  derived and/or modified sequence opt2 from anti-HIV_cap256-206-136316_VR-Chain
caggagcagcucgucgaguccggcggcggcgucgucccccccggcaagucccucacccucuccugcgucgccuccggcuucaccuucuccgccuucggcaugcacuggguccgccaggcccccggcaagggccucgagugggucgccggcaucuccuucgucggcaucaagaaguacuacggcgacuccgucaagggccgcuucaccaucucccgcgacaacuccaagaacacccucuuccuccagaugaacggccuccgcggcgacgacaccgcccucuaccacugcgucaaggacaugcgccagcucgagugcgaggaguggaccuccgacuacuacgacuucggcaagccccagcccugcaucgacccccgcggcgucuccggcaucuccgccauguggggccagggcaccauggucaccgucuccucc

SEQ ID NO: 16977 - RNA, 438 nt, Artificial Sequence
  derived and/or modified sequence opt2 from anti-HIV_cap256-206-116098_VR-Chain
cagaugaugcucgucgaguccggcggcggcgucgucgagcccggccgcucccucacccucuccugcgccgccucccaguucaccuucuccaacuacggcaugcacuggguccgccaggcccccggccgcgagcucgagugggucgccuccaucuccaacgccggcaacaagaaguaccacggcgaggccgucuggggccgccucaucaucucccgcgacaacuccaagaacacccucuuccuccacauguccaaccuccgccccgacgacuccgcccucuacuucugcguccgcgaccgccaggaggacgagugcgaggaguggugguccgacuacuacgccuucggccgcggcggccccugccgcaaguaccacggccagggccucgccggcaucuucgacaucuggggccgcggcaccauggucaccgucuccucc

SEQ ID NO: 16978 - RNA, 432 nt, Artificial Sequence
  derived and/or modified sequence opt2 from anti-HIV_cap256-206-115862_VR-Chain
caggagcagcucgucgaguccggcggcggcgucgucccccccggcaagucccuccgccucuccugcgucggcucccgcuucaccuucuccgccuucggcaugcacuggguccgccaggcccccggcaagggccucgagugggucgccuccaucuccuucgccggcaccaagaaguacuacgucgacuccgucaagggccgcuucuucaucucccgcgacaacuccaagaacaccgucuuccucgagaugaacggccuccgcggcgaggacaccggccucuacuacugcgucaaggacaugcgcgagcucgagugcgaggagugggccuccgacuacuacgacuucggcaagccccagcccugccucgaccgccgcggcgucuccggcaucuccgccauguggggccagggcacccucgucaucaucuccucc

SEQ ID NO: 16979 - RNA, 435 nt, Artificial Sequence
  derived and/or modified sequence opt2 from anti-HIV_cap256-206-107018_VR-Chain
caggagcagcucgucgaguccggcggcggcgucgucccccccggcaagucccucacccucuccugcgucgccucccgcuucuccuucuccgccuucggcaugcacuggguccgccaggcccccggcaagggccucgagugggucgccuccaucuccuucgucggcaucaagaaguacuacggcgacuccgucaagggccgcuucuucaucucccgcgacaacuccaagaacaccgucuuccucgagaugaacggccuccgcggcgaggacaccggccucuacuacugcgucaaggacaugcgcgagcucgagugcgaggagugggccuccgacuacuacgacuucggcaagcccaaccagcccugccucgaccgccgcggcgucuccggcaucuccgccauguggggccagggcacccucgucaucgucuccucc

SEQ ID NO: 16980 - RNA, 438 nt, Artificial Sequence
  derived and/or modified sequence opt2 from anti-HIV_cap256-206-098644_VR-Chain
cagaugcuccucgucgaguccggcggcggcgucgucgagcccggccgcucccucacccucuccugcgccgccucccaguucaccuucuccaacuacggcaugcacuggguccgccaggcccccggcggcggccucgagugggucgccuccaucuccaacgagggcaacaagcgcuaccacggcgaguccgucuggggccgcuucgucaucucccgcgacaacuccaagaacacccucuuccuccacauguccacccuccgccccgacgacuccgcccucuacuucugcguccgcgaccgccaggaggacgagugcgaggaguggugguccgacuacuacgccuucggccgcggcggccccugccgcaaguaccacggccagggccucgccggcaucuucgacgucuggggccgcggcaccauggucaccggccucuuc

SEQ ID NO: 16981 - RNA, 417 nt, Artificial Sequence
  derived and/or modified sequence opt2 from anti-HIV_cap256-206-098135_VR-Chain
caggagaagcucgucgaguccggcggcggcgccguccagcccggcggcucccuccgccucuccugcgucgccuccggcuucaccuucuccggcuucggcaugcacuggguccgccaggcccccggcaagggccucgagugggucgccaccaucuccuucuccggcaugaagaaguacuacggcaccuccgccaagggccgcuucuccaucuaccgcgacaacuccaagaacacccucuaccuccagauggacggccuccgcgagaaggacaccgcccucuacuacugcgccaaggaccuccgcuaccucgagugcggcgagugguccaccuacuacccccagcccugccucgaccgccgcggcgucuccggcaucuccaacgucuggggccccggcaccauggucaccgucuccucc

SEQ ID NO: 16982 - RNA, 435 nt, Artificial Sequence
  derived and/or modified sequence opt2 from anti-HIV_cap256-206-096276_VR-Chain
caggagcagcucgucgaguccggcggcggcgucgucccccccggcuccucccuccgccucuccugcgucgccucccgcuucaccuucuccgccuucggcaugcacuggguccgccaggcccccggcaagggccucgagugggucgccggcaucuccuucgucggcaucaagaaguacuacgccgacuccgucaagggccgcuucaccaucucccgcgacaacuccaagaacacccucuuccuccagaugaacggccuccgcggcgaggacaccggccucuacuacugcgucaaggacaugcgcgagcucgagugcgaggaguggcgcuccgacuacuacgacuucggcaagcccaaccagcccuaccucgaccgccgcggcgucuccggcaucuccgccuucuggggccagggcaccauggucaccgucuccucc

SEQ ID NO: 16983 - RNA, 438 nt, Artificial Sequence
  derived and/or modified sequence opt2 from anti-HIV_cap256-206-092794_VR-Chain
cagaugaugcucgucgaguccggcggcggcgucgucgagcccggccgcucccucacccucuccugcgccaccucccaguucaccuucuccaacuacggcaugcacuggguccgccaggcccccggccgcggccucgagugggucgccuccaucuccaacgagggcaacaagcgcuaccacggcgaguccgucuggggccgcuucaucaucucccgcgacaacuccaagaacacccucuuccuccacauguccacccuccgcgccgacgacuccgcccucuacuucugcguccgcgaccgccaggaggacgagugcgaggaguggugguccgacuacuacgccuucggccgcggcggccccugccgcaaguaccacggccagggccucgccggcaucuucgacaucgucggccgcggcacccucgucaccgucuccucc

SEQ ID NO: 16984 - RNA, 432 nt, Artificial Sequence
  derived and/or modified sequence opt2 from anti-HIV_cap256-206-086817_VR-Chain
caggagcagcucgucgaguccggcggcggcgucgucccccccggcaagucccuccgccucuccugcgccgccuccggcuucuccuucggcgccuucggcaugcacuggguccgccaggcccccggcaagggccucgagugggucgccggcaucuccuucgucggcaucaaguacuacuacgccgacuccgucaagggccgcuucaccaucucccgcgacaacuccaagaacaccgucuuccuccagaugaacggccuccgcggcgacgacaccggccgcuacuacugcgucaaggacaugcgcgagcucgagugcgaggaguggaccuccgacuacuacgacuucggcaagccccagcccugcaucgaccgccgcggcgucuccggcaucuccgccauguggggccagggcaccauggucaccaucuccucc

SEQ ID NO: 16985 - RNA, 432 nt, Artificial Sequence
  derived and/or modified sequence opt2 from anti-HIV_cap256-206-086446_VR-Chain
caggagcagcucgucgaguccggcggcggcgucgucccccccggcaagucccuccgccucuccugcgucgccucccgcuucaccuucuccgccuucggcaugcacuggguccgccaggcccccggcaagggccucgagugggucgccggcaucuccuucgucggcaucaagaaguacuacuccgacgccgucaagggccgcuucuacaucucccgcgacaacuccaagaacacccucuuccucgagaugaacggccuccgcggcgacgacaccgcccgcuacuacugcgucaaggaccuccgcgagcucgagugcgaggagugggccuccgacuacuacgacuucggcaagccccagcccugccucgacucccgcggcgucuccggcaucuccgccauguggggccagggcaccauggucaccgucuccucc

SEQ ID NO: 16986 - RNA, 432 nt, Artificial Sequence
  derived and/or modified sequence opt2 from anti-HIV_cap256-206-086180_VR-Chain
caggagcagcucgaggaguccggcggcggcgucgucccccccggcaagucccuccgccucuccugcgucgccucccgcuucaccuucuccgccuucggcaugcacuggguccgccaggcccccggcaagggccucgagugggucgccggcaucuccuucgucggcaucaagaaguacuacgccgacuccgucaagggccgcuucaccaucucccgcgacaacuccaagaacacccucuuccuccagaugaacggccuccgcggcgacgacaccggccucuacuucugcgucaaggacaugcgcgagcucgagugcgagcaguggaccuccgacuacuacgacuucggcaagccccagcccugcaucgacccccgcggcgucuccggcaucuccgccauguggggccagggcaccauggucaccgucuccucc

SEQ ID NO: 16987 - RNA, 435 nt, Artificial Sequence
  derived and/or modified sequence opt2 from anti-HIV_cap256-206-083708_VR-Chain
caggagcagcucgucgaguccggcggcggcgucaucccccccggccagucccuccgccucuccugcgucgccucccgcuucaccuucuccgccuucggcaugcacuggguccgccaggcccccggcaagggccucgagugggucuccuccgucuccuucgccggcaucaagaaguacuacgccgacuccgucaagggccgcuucuucaucucccgcgacaacuccaagaacaccgucuuccucgagaugaacggccuccgcggcgaggacaccggccucuacuacugcgucaaggacaugcgcgagcucgagugcgaggagugggccuccgacuacuacgacuucggcaagcccgaccagcccugccucgaccgccgcggcgucuccggcaucuccgccauguggggccagggcacccucgucaucgucuccucc

SEQ ID NO: 16988 - RNA, 432 nt, Artificial Sequence
  derived and/or modified sequence opt2 from anti-HIV_cap256-206-079556_VR-Chain
caggagcagcucgucgaguccggcggcggcgucgucccccccggcaagucccuccgccucuccugcgucgccuccggcuucaccuucuccggcuucggcaugcacuggguccgccaggcccccggcaagggccucgagugggucgccggcaucuccuucgucggcaucaaguacuacuacgccgacuccgucaagggccgcuucuccaucucccgcgacaacuccaagaacacccucuuccuccagaugaacggccuccgcggcgacgacaccgcccucuacuacugcgucaaggacaugcgcgagcucgagugcgaggaguggaccuccgacuacuacgacuucggcaagccccagcccugcaucgaccgccgcggcgucuccggcaucuccgccauguggggccagggcaccauggucaccgucuccucc

SEQ ID NO: 16989 - RNA, 438 nt, Artificial Sequence
  derived and/or modified sequence opt2 from anti-HIV_cap256-206-078657_VR-Chain
cagaugcuccucgucgaguccggcggcggcgucgucgagcccggccgcucccucacccucuccugcgccaccucccaguucaccuucuccaacuacggcaugcacuggguccgccaggcccccggccgcggccucgagugggucgccuccaucuccaacgagggcuccaagaaguaccacggcgagcccgucuggggccgcuucaucaucucccgcgacaacuccaagaagacccucuuccuccacauguccaaccuccgcgucgacgacuccgcccucuacuucugcguccgcgaccgccaggaggacgagugcgaggaguggugguccgacuacuacgccuucggccgcggcggccccugccgcaaguaccacggccagggccucgccggcaucuucgacaucuggggccgcggcaccauggucaccgucuccucc

SEQ ID NO: 16990 - RNA, 438 nt, Artificial Sequence
  derived and/or modified sequence opt2 from anti-HIV_cap256-206-075802_VR-Chain
cagaugcuccucgucgaguccggcggcgacgucgucgagcccggcaagucccucacccucuccugcgccaccucccgcuucaccuucuccaacuacggcaugcacuggguccgccaggcccccggcggcggccucgagugggucgccuccaucuccaacgagggcaacaagaaguaccacggcgaguccgucuggggccgcuucaucaucucccgcgacaacuccaagaacacccucuuccuccacauguccgcccuccgcaccgacgacuccgcccucuacuucugcguccgcgaccgccaggaggacgagugcgaggaguggugguccgacuacuacgccuucggccgcggcggccccugccgcaaguaccacggccagggccucgccggcaucuucgacaucuggggccgcggcaccauggucaccgucuccucc

SEQ ID NO: 16991 - RNA, 438 nt, Artificial Sequence
  derived and/or modified sequence opt2 from anti-HIV_cap256-206-069097_VR-Chain
cagaugcuccucgucgaguccggcggcggcgucgucgagcccggccgcucccucacccucuccugcgccaccucccgcuucaccuucuccaacuacggcaugcacuggguccgccaggcccccggccgcgagcucgagugggucgccuccaucuccaacgagggcaacaagaaguaccacgccgaguccgucuggggccgcuucaucaucucccgcgacaacuccaagaacacccucuuccuccacauguccaacguccgcggcgacgacuccgcccucuacuucugcguccgcgaccgccaggaggacgagugcgaggaguggugguccgacuacuacgccuucggccgcggcggccccugccgcaaguaccacggccagggccucgccggcaucuucgacgucuggggccgcggcaccgucgucaccgucuccucc

SEQ ID NO: 16992 - RNA, 438 nt, Artificial Sequence
  derived and/or modified sequence opt2 from anti-HIV_cap256-206-067758_VR-Chain
cagaugcuccucgucgaguccggcggcggcgucgucgagcccggccgcucccucacccucuccugcgccgccucccaguucaccuucucccacuacggcaugcacuggguccgccaggcccccggccgcggccucgagugggucgccuccaucuccaacgagggcaacaagcgcuaccacggcgaguccgucuggggccgcuucaucaucucccgcgacaacuccaagaacacccucuuccuccacauguccgcccuccgcaccgacgacuccgcccucuacuucugcguccgcgaccgccaggaggacgagugcgaggaguggugguccgacuacuacgccuucggccgcggcggccccugccgcaaguggcacggccagggccucgccggcaucuucgacaucuggggccgcggcaccgucgucaccgucuccucc

SEQ ID NO: 16993 - RNA, 417 nt, Artificial Sequence
  derived and/or modified sequence opt2 from anti-HIV_cap256-206-057019_VR-Chain
caggagaagcucgucgaguccggcggcggcgccguccagcccggcggcucccuccgccucuccugcgucgccuccggcuucuccuucuccggcuacggcaugcacuggguccgccaggcccccggcaagggccucgaguggcucgccaccaucuccuucuccggcgucaagaaguacuacggcaccuccgccaagggccgcuucuacaucuaccgcgacaacaccaagaacaccauguaccucgagaugaacggccuccgcggcgaggacaccgcccucuacuacugcgccaaggaccuccgcuaccucgagugcggcgagugguccaccuacuacccccagcccugccucgacacccgcggcgucuccggcaucuccaacgucuggggccccggcaccauggucaccgucuccucc

SEQ ID NO: 16994 - RNA, 438 nt, Artificial Sequence
  derived and/or modified sequence opt2 from anti-HIV_cap256-206-055385_VR-Chain
cagaugaugcucgucgaguccggcggcggcgucgucgagcccggccgcucccucacccucuccugcgccgccuccaaguucaccuucuccaacuacggcaugcacuggguccgccaggcccccggccgcggccucgagugggucgccuccaucuccaacgagggcaacaagaaguaccacggcgagcccgucuggggccgccucaucaucucccgcgacaacuccaagaacacccucuuccuccacauguccgaccuccgcgccgacgacuccgcccucuacuucugcguccgcgaccgccaggaggacgagugcgaggaguggugguccaacuacuacgccuucggccgcggcggccccugccgcaaguggcgcggccagggccucgccggcaucuucgacgucuggggccgcggcaccauggucaccgucuccucc

SEQ ID NO: 16995 - RNA, 435 nt, Artificial Sequence
  derived and/or modified sequence opt2 from anti-HIV_cap256-206-053187_VR-Chain
caggagcagcucgucgaguccggcggcggcgucgucccccccggcuccucccuccgccucuccugcgucgccucccgcuucaccuucuccgccuucggcaugcacuggguccgccaggcccccggcaagggccucgagugggucgccggcaucuccuucgucggcaucaaguacuacuacgccgacuccgucaagggccgcuucaccaucucccgcgacaacuccaagaacacccucuuccuccagaugaacggccuccgcggcgaggacaccggccucuacuacugcgucaaggacaugcgcgagcucgagugcgaggagugggccuccgacuacuacgacuucggcaagcccaaccagcccugccucgaccgccgcggcgucuccggcaucuccgccuucuggggccagggcaccauggucaccgucuccucc

SEQ ID NO: 16996 - RNA, 438 nt, Artificial Sequence
  derived and/or modified sequence opt2 from anti-HIV_cap256-206-053139_VR-Chain
cagaugcuccucgucgaguccggcggcgacgucgucgagcccggccgcucccucacccucuccugcgccaccucccaguucaccuucuccaacuacggcaugcacuggguccgccaggcccccggccgcggccucgagugggucgccuccaucuccaacgagggcuccaagaaguaccacggcgaguccgucuggggccgcuucaucaucucccgcgacaacuccaagaacacccucuuccuccacaugaccacccuccgccccgacgacuccgcccucuacuucugcguccgcgaccgccaggaggacgagugcgaggaguggugguccgacuacuacgccuucggccgcggcggccccugccgcaaguaccacggccagggccucgccggcaucuucgacaucuggggccgcggcaccauggucaccgucuccucc

SEQ ID NO: 16997 - RNA, 432 nt, Artificial Sequence
  derived and/or modified sequence opt2 from anti-HIV_cap256-206-050350_VR-Chain
caggagcagcucgucgaguccggcggcggcgucgucccccccggcaagucccucaagcucuccugcgucgccucccgcuucuccuucggcgccuucggcaugcacuggguccgccaggcccccggcaagggccucgagugggucgccggcaucuccuucgucggcaucaagaaguacuacgccgacuccgucaagggccgcuucuacaucucccgcgacaacuccaagaacaccgucuuccucgagaugaacgcccuccgcggcgaggacaccgcccucuaccacugcgucaaggacaugcgcgagcucgagugcgaggagugggccuccgacuacuacgacuucggcaagccccagcccugccucgaccgccgcggcgucuccggcaucuccgccauguggggccccggcaccauggucaucgucuccucc

SEQ ID NO: 16998 - RNA, 432 nt, Artificial Sequence
  derived and/or modified sequence opt2 from anti-HIV_cap256-206-046207_VR-Chain
caggagcagcucgucgaguccggcggcggcgucgucccccccggcaccucccuccgccucuccugcgucgccucccgcuucaccuucuccgccuucggcaugcacuggguccgccaggcccccggcaagggccucgagugggucgccggcaucuccuucgccggcaucaagaaguacuacgccgacuccgucaagggccgcuucaccaucucccgcgacaacuccaagaacucccucuuccucgagaugaacggccuccgcggcgacgacaccgcccucuacuacugcgucaaggaccuccgcuaccucgagugcgagcucuggaccuccgacuacuacgacuucggccgcccccagcccugcaucgacucccgcggcgucuccggcaucuccgccauguggggccccggcaccauggucaccgucuccgcc

SEQ ID NO: 16999 - RNA, 417 nt, Artificial Sequence
  derived and/or modified sequence opt2 from anti-HIV_cap256-206-043389_VR-Chain
caggagaagcucgucgaguccggcggcggcgccguccagcccggcggcucccuccgccucuccugcgucgccuccggcuucaccuucuccggcuucggcaugcacugguuccgccaggcccccggcaagggccucgagugggucgccaccaucuccuucuccggcaucaagaaguacuacaacaccuccgccaagggccgcuucuucaucucccgcgacaacaccaaggacacccucuaccuccagauggacggccuccaggagaaggacaccgcccucuaccucugcgccaaggaccuccgcuaccucgagugcggcuacugguccaccuacuacccccagcccugccucgacacccgcggcgucuccggcaucuccaacgucuggggccccggcaccauggucaccgucuccucc

SEQ ID NO: 17000 - RNA, 432 nt, Artificial Sequence
  derived and/or modified sequence opt2 from anti-HIV_cap256-206-042555_VR-Chain
caggagcagcucgucgaguccggcggcggcgucgucccccccggcaagucccuccgccucuccugcgucgucuccggcuucaccuucuccgccuucggcaugcacuggguccgccaggcccccggcaagggccucgagugggucgccggcaucuccuucgccggcaccaaguccuacuacgccgaguccgucaagggccgcuucaccaucucccgcgacaacuccaagaacucccucuuccuccagaugaacggccuccgcggcgacgacaccgcccucuacuacugcgucaaggacaugcgcgagcucgagugcgagcucuggaccuccgacuacuacgacuucggccgcccccagcccugcaucgaccgccgcggcgucuccggcaucuccgccauguggggccagggcaccauggucaccaucuccucc

SEQ ID NO: 17001 - RNA, 432 nt, Artificial Sequence
  derived and/or modified sequence opt2 from anti-HIV_cap256-206-029720_VR-Chain
caggagaagcucgucgaguccggcggcggcgucguccagcccggccgcucccucacccucuccugcgucgccucccacuucaccuucuccggcgucggcaugcacuggguccgccaggcccccggcaagggccucgagugggucgccggcaucuccuucgccggcacccgcaaguacuacgccgacuccgucaagggccgcuucaccaucucccgcgacaacuccaagaacaccgucuaccuccagaugaacggccuccgcggcgaggacaccgcccucuaccacugcgccaaggaccuccgcgagcucgagugcgagcucuggaccuccgacuacuacgacuucggccgcccccagcccugcaucgaccgccgcggcgucuccggcaucugcgacauguggggccagggcaccauggucaucgucuccucc

SEQ ID NO: 17002 - RNA, 432 nt, Artificial Sequence
  derived and/or modified sequence opt2 from anti-HIV_cap256-206-028848_VR-Chain
caggagcagcucgucgaguccggcggcggcgucgucccccccggcaagucccuccgccucuccugcgucgccuccggcuucaccuucuccggcuucggcaugcacuggguccgccaggcccccggcaagggccuccagugggucgccggcaucuccuucgccggcaccaaguacuacuacgaggacuccgucaagggccgcuucaccaucucccgcgacaacuccaagaacaccgucuuccuccagaugaacggccuccgcggcgacgacaccgcccucuacuacugcgucaaggacaugcgcgagcucgagugcgaggaguggaccuccgacuacuacgacuucggcaagccccagcccugcaucgaccgccgcggcgucuccggcaucuccgccauguggggccagggcaccauggucaccaucuccucc

SEQ ID NO: 17003 - RNA, 432 nt, Artificial Sequence
  derived and/or modified sequence opt2 from anti-HIV_cap256-206-027652_VR-Chain
caggagcagcucgucgucuccggcggcgacgucgucccccccggcaagucccuccgccucuccugcgucgccuccggcuucaccuucuccgccuucggcaugcacuggguccgccaggcccccggcaagggccucgagugggucgccuccaucuccuucgccggcaccaaguacuacuacgccgacuccgucaagggccgcuucgccaucucccgcgacaacuccaagaacacccucuuccuccagaugaacggccuccgccgcgaggacaccggccucuacuacugcgucaaggacaugcgccagcucgagugcgaggaguggaccuccgacuacuacgacuucggccgcccccagcccugcaucgaccgccgcggcgucuccggcaucuccgccauguggggccagggcaccauggucaccaucuccucc

SEQ ID NO: 17004 - RNA, 417 nt, Artificial Sequence
  derived and/or modified sequence opt2 from anti-HIV_cap256-206-024075_VR-Chain
caggagaagcucgucgaguccggcggcggcgccguccagcccggcggcucccuccgccucuccugcgucgccuccggcuucaccuucuccggcuucggcaugcacuggguccgccaggcccccggcaagggccucgaguggcucgccaccaucuccuucuccggcgucaagaaguacuacggcaccuccgccaagggccgcuucuacaucucccgcgacaacaccaagaacaccgucuaccuccagauggacggccuccgcggcgacgacaccgccaucuacuacugcgccaaggaccuccgcuuccucgagugcggccucugguccaccuacuacccccagcccugccucgacacccgcggcgucuccggcaucuccaacgucuggggccccggcaccauggucaccgucuccucc

SEQ ID NO: 17005 - RNA, 417 nt, Artificial Sequence
  derived and/or modified sequence opt2 from anti-HIV_cap256-206-008748_VR-Chain
caggagaagcucgucgaguccggcggcggcgccguccagcccggcggcucccuccgccucuccugcgucgccuccggcuucaccuucaacggcuucggcaugcacuggguccgccaggcccccggcaagggccucgagugggucgccaccaucuccuucuccggcgucaagaaguacuacggcaccuccgccaagggccgcuucuucaucucccgcgagaacuccaagaacacccucuaccuccagaugaacggccuccgcggcgaggacaccgcccucuacuacugcgccaaggaccuccgcuaccucgagugcggcgagugguccaccuacuacccccagcccugccucgacacccgcggcgucuccggcaucuccaacgucuggggccccggcacccgcgucaccgucuccucc

SEQ ID NO: 17006 - RNA, 432 nt, Artificial Sequence
  derived and/or modified sequence opt2 from anti-HIV_cap256-206-008530_VR-Chain
caggagcagcucgucgaguccggcggcggcgucgucccccccggcaagucccuccgccucuccugcgucgccuccggcuucuccuucggcgccuucggcaugcacuggguccgccaggcccccggcaagggccucgagugggucgccggcaucuccuucgucggcaucaaguacuacuacgccgacuccgucaagggccgcuucaccaucucccgcgacaacuccaagaagacccucuuccuccagaugaacggccuccgcggcgacgacaccgcccucuacuacugcgucaaggacaugcgcgagcucgagugcgaggaguggaccuccgacuacuacgacuucggcaagccccagcccugcaucgaccgccgcggcgucuccggcaucuccgccuucuggggccagggcaccauggucaccaucuccucc

SEQ ID NO: 17007 - RNA, 432 nt, Artificial Sequence
  derived and/or modified sequence opt2 from anti-HIV_cap256-176-723043_VR-Chain
caggagcagcucgucgaguccggcggcggcgucgucccccccggcaagucccuccgccucuccugcgucgccuccggcuucaccuucuccgccuucggcaugcacuggguccgccaggcccccggcaagggccucgagugggucgccggcgucuccuucgccggcaucaaguacuacuacgccgacuccgucaagggccgcuucaccaucucccgcgacaacuccaagaacacccucuuccuccagaugaacggccuccgcggcgacgacaccgcccucuacuacugcgucaaggaccuccgcgagcucgagugcgaggaguggaccuccgacuacuacgacuucggccgcccccagcccugcaucgacccccgcggcgucuccggcaucuccgccauguggggccagggcaccgucgucaccaucuccucc

SEQ ID NO: 17008 - RNA, 432 nt, Artificial Sequence
  derived and/or modified sequence opt2 from anti-HIV_cap256-176-600049_VR-Chain
gagguccagcucguccaguccggcggcggcgucguccagcccggccgcucccuccgccucuccugcgccgcccccuacuucgaguucggccgcuacggcuuccacuggguccgccaggcccccggcaagggccucgagugggucgccuccaucuccuucgccggccgcggcuacuaccacucccccuccgucuggggccgcuucaccaucucccgcgacaacuccaagaacacccucuaccuccagaugaacucccuccgcaucgaggacaccgcccucuacuucugcgcccgcgaccuccgcgaguccgagugcgaggagugggaguccgacuacuacgacuucggcaagaagggccccugcgucaagccccgcggcgucgccggcggccucgaccucuggggccagggcaccauggucaucgucuccucc

SEQ ID NO: 17009 - RNA, 432 nt, Artificial Sequence
  derived and/or modified sequence opt2 from anti-HIV_cap256-176-531926_VR-Chain
cagguccagcucgucgaguccggcggcggcgucgucccccccggcaagucccucacccucuccugcgucgccucccgcuucaccuucuccgccuucggcaugcacuggguccgccaggcccccggcaagggccucgagugggucgccggcaucuccuucgucggcauccgcaaguacuacgccgacuccgucaagggccgcuucuccaucucccgcgacaacuccaagaacaccgucuuccucgagaugaacggccuccgcggcgaggacaccggccucuacuacugcgucaaggacaugcgcgagcucgagugcgaggagugggccuccgacuacuacgacuucggcaagccccagcccugccucgaccgccgcggcgucuccggcaucuccgccauguggggccagggcacccucgucaucaucuccucc

SEQ ID NO: 17010 - RNA, 432 nt, Artificial Sequence
  derived and/or modified sequence opt2 from anti-HIV_cap256-176-504134_VR-Chain
gagguccagcucgucgaguccggcggcggcgucgucccccccggcaagucccuccgccucuccugcgucaccucccgccucgccuucggcgccuucggcaugcacuggguccgccaggcccccggcaagggccucgagugggucgccuccaucuccuucgccggcaucaagaaguacuacgccgacuccgucaagggccgcuucaccaucucccgcgacaacuccaaggacaccgucuuccucgagaugaacggccuccgcggcgacgacaccggccucuacuacugcgucaaggacaugcgcuaccucgagugcgaggagugggccuccgacuacuacgacuucggccgcccccagcccugccucgacccccgcggcgucuccggcaucuccgccauguggggccagggcacccucgucaucaucuccucc

SEQ ID NO: 17011 - RNA, 432 nt, Artificial Sequence
  derived and/or modified sequence opt2 from anti-HIV_cap256-119-186229_VR-Chain
cagaugcagcucgucgaguccggcggcggcgucguccagcccggcggcucccuccgccuccucugcuccgccuccggcuucaccuucuccaccuacggcaugcacuggguccgccaggcccccggcaagggccucgagugggucgccuccaucuccuacgacggcuccgacaaguaccacgccggccucgucuggggccgcuucaucaucucccgcgacaacuccaagaacacccucuaccuccagaugaacucccuccgcgccgaggacaccgcccucuacuacugcguccgcgacgagcgcgaguccgagugcgagcucugggaguccgacuacuacaacuucggcaagaagcuccccugcgucaagccccgcggcgucgccggcacccucgacaucuggggccagggcaccaccgucaucgucuccucc

SEQ ID NO: 17012 - RNA, 432 nt, Artificial Sequence
  derived and/or modified sequence opt2 from anti-HIV_cap256-119-183891_VR-Chain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucacccgcuacgacggcuccgacaaguacuaccucgacuccgucaagggccgcuucaccaucucccgcgacaacuccaaguacacccucuuccuccagauggucucccuccgcaccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17013 - RNA, 435 nt, Artificial Sequence
  derived and/or modified sequence opt2 from anti-HIV_cap256-119-183631_VR-Chain
cagguccagcucguccaguccggcggcggcgucguccagcccggccgcucccuccgccucuccugcgccgccuccaaguucaccuucuccaccuacacccuccacuggguccgccaggcccccggcaagggccucgagugggucgccgucaucucccacgacggcggcaaccgcuucuacgccgacuccgucaagggccgcuucaccaucucccgcgacaacuccaagaacaaccucuuccuccagaugaacucccuccgcgucgaggacaccgcccucuacuacugcgcccgcgaccuccgcgagauggagugcgaggaguggacccucuacaacuacuacgacuucggcucccgcggccccugcgucgacccccgcggcgucgucggcuccuucgacgucuggggccagggcaccauggucaccgucuccucc

SEQ ID NO: 17014 - RNA, 432 nt, Artificial Sequence
  derived and/or modified sequence opt2 from anti-HIV_cap256-119-182676_VR-Chain
cagguccagcucgucgaguccggcggcggcgucguccagcccggcaagucccuccgccucuccugcgucgucuccggcuucaccuucuccaacuaccccaugcacuggguccgccaggcccccggcaagggccucgagugggucgccuccaucuccuucgccggcaucaagaaguacuacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17015 - RNA, 432 nt, Artificial Sequence
  derived and/or modified sequence opt2 from anti-HIV_cap256-119-180772_VR-Chain
cagguccagcucgucgaguccggcggcggcgucguccagcccggccgcucccuccgccucuccugcgccgccuccgaguucaccuucuccaacuacgccaugcacuggguccgccaggcccccggcaagggccucgagugggucgccuccaucuccuucgacggccgcgacaaguaccacuccucccucgucuggggccgccucaccaucucccgcgacaacuccaaguccacccucuuccuccagaugaacucccuccgccccgaggacaccgcccucuacuacugcgcccgcgacguccgcgaguccgagugcgaggaguggcaguccgacuacuacgccuucuaccgcaagcuccccugcgucaagccccgcggcgucgccggcacccucgacaucuggggccagggcaccauggucaccgucuccucc

SEQ ID NO: 17016 - RNA, 435 nt, Artificial Sequence
  derived and/or modified sequence opt2 from anti-HIV_cap256-119-180508_VR-Chain
cagguccaccucgucgaguccggcggcggcgucguccagcccggccgcucccuccgccucuccugcgccgccucccacuucucccucuccuccuacggcaugcacuggguccgccagacccccggcaagggccucgagugggucgccggcaucuccuucgccggcgucaagaccuacuacggcaccuccgucaagggccgcuucaccaucucccgcgacaacuccaagaacaaccucuaccuccagaugaacucccuccgccccgaggacaccgcccucuacuacugcgcccgcgaccuccgcgagauggagugcgaggaguggaagcucuacaacuacuacgacuuccgcacccgcggccccugcgucgacccccgcggcgucgucggcuccuucgacgucuggggccagggcaccgucgucaccgucuccucc

SEQ ID NO: 17017 - RNA, 432 nt, Artificial Sequence
  derived and/or modified sequence opt2 from anti-HIV_cap256-119-180260_VR-Chain
gagguccagcucgucgaguccggcggcggcgucguccgccccggcggcucccuccgccucuccugcgccgccucccaguucaccuucuccaacuucggcaugcacuggguccgccaggcccccggcaagggccucgagugggucgccuccaucuccuucgucggcaucaagacccacuacgccaacuccguccgcggccgcuucaccaucucccgcgaccaguccaagaacacccucuaccuccagaugaacuccguccgcgucgaggacaccggccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17018 - RNA, 432 nt, Artificial Sequence
  derived and/or modified sequence opt2 from anti-HIV_cap256-119-180173_VR-Chain
gagguccagcucgucgaguccggcggcggccucguccagcccggcggcucccuccgccucuccugcgccgccuccggcuucaccgucuccuccaacuacauguccuggguccgccaggcccccggcaagggccucgagugggucgccuccaucuccuucgccggcaccaagaagcacuacggcaacuccgucaagggccgcuucaccaucucccgcgacaacuccaagaacacccucuaccuccagaugaacucccuccgcggcgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17019 - RNA, 432 nt, Artificial Sequence
  derived and/or modified sequence opt2 from anti-HIV_cap256-119-179839_VR-Chain
cagguccagcucgucgaguccggcggcggcgucguccagcccggccgcucccuccgccucuccugcgccgccuccggcuucuccuucggcaccuccgacguccacuggguccgccaggcccccggcgagggccucgagugggucgcccucaucuccuucgacggccgccagaaggaccucgccgacuccguccgcggccgcuucaccaucucccgcgacuccuccaagaacacccucuaccucgagaugaacucccuccgccccgaggacaccgcccucuacuacugcgccaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17020 - RNA, 423 nt, Artificial Sequence
  derived and/or modified sequence opt2 from anti-HIV_cap256-119-179262_VR-Chain
cagguccagcucgucgaguccggcggccgcgucguccaguccggcggcucccuccgccucuccugcggcgccuccggcuucuccuucaccaccuccgccaugcacuggguccgccaggcccccggcaagggccucgagugggucgccaucaacggcgccaacaagcacuacgccgaguccgucaagggccgcuucaccaucucccgcgacaacuccaagaacacccucuuccucgagaugaacucccuccgccccgacgacaccgcccucuacuucugcgucaaggaccagcgcgaggacgagugcgaggaguggugguccgacuacuacgacuucggccgcgagcagcccugccucgacccccgcggcgucgucggcaucuucgaccucuggggccagggcaccauggucaccgucuccucc

SEQ ID NO: 17021 - RNA, 432 nt, Artificial Sequence
  derived and/or modified sequence opt2 from anti-HIV_cap256-119-178995_VR-Chain
cagguccagcucgucgaguccggcggcggcgucguccagcccggcaagucccuccgccucuccugcgccgccuccggcuucacccucacccgcuucgccaugcacuggguccgccaggcccccggcaagggccucgagugggucgccgucaucugguacgacggcuccaacaaguacuacgccgacuccgucaagggccgcuucaccgucucccgcgacaacuccaagaacacccucuaccuccagaugaacucccuccgcaccgaggacaccgcccucuacuacugcguccgcgaccgccgcgaguccgagugcgagcucugggaguccgacuacuacaacuucggccgccgccuccccugcgucaagccccgcggcgucgccggcauccucgacaucuggggccagggcaccaccgucaccgucuccccc

SEQ ID NO: 17022 - RNA, 432 nt, Artificial Sequence
  derived and/or modified sequence opt2 from anti-HIV_cap256-119-178455_VR-Chain
gagguccagcucgucgaguccggcggcggccucguccagcccggcggcucccuccgccucuccugcgucgucuccggcuucaccuucuccaacuucuggauguccuggguccgccaggcccccggcaagggccucgagugggucgccuccaucuccuacgacggccgcgacaaguaccacuccucccucgucuggggccgccucaccaucucccgcgacaacuccaaguccacccucuuccuccagaugaacucccuccgcgccgaggacaccgcccucuacuacugcgcccgcgaccuccgcgaguccgagugcgaggaguggcaguccgacuacuacgccuucuacaagaagcuccccugcgucaagccccgcggcgucgccggcacccucgacaucuggggccagggcaccauggucaccgucuccucc

SEQ ID NO: 17023 - RNA, 438 nt, Artificial Sequence
  derived and/or modified sequence opt2 from anti-HIV_cap256-119-177993_VR-Chain
cagguccaccucgucgaguccggcggcggcgucguccagcccggcaagucccuccgcaucuacugcgccgucuccgaguucaccuucuccaacuacgccaugcacuggguccgccucgcccccggccgcggccuccaguggcucgccgucaucuccuacgacggcuccaagaaguacuacgccgacucccucgagggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggcgagcgcgccccccuccccaagguccccggccccggccccggcuggaaccucgacauguggggccacggcaccauggucaccgucuccucc

SEQ ID NO: 17024 - RNA, 438 nt, Artificial Sequence
  derived and/or modified sequence opt2 from anti-HIV_cap256-119-177727_VR-Chain
cagguccagcucgucgaguccggcggcggcgucguccagcccggccgcucccuccgccucuccugcgccgccuccggcuucacccucucccgcuacgacaugcacuggguccgccaggcccccggcaagggccucgagugggucgccuccaucuccaaggacggcaccaagaaguaccacggcgacuccgucuggggccgcuucaucaucucccgcgacaacuccaagaacacccucuuccuccagauguccucccuccgcgccgaggacaccgcccucuacuucugcguccgcgaccagcgcgaggccgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17025 - RNA, 432 nt, Artificial Sequence
  derived and/or modified sequence opt2 from anti-HIV_cap256-119-176746_VR-Chain
gagguccagcucgucgaguccggcggcggccucguccagcccggcggcucccuccgccucuccugcgccgccuccgacuucaccuucgacgacuacgccaugcacuggguccgccaggcccccggcaagggccucgagugggucggcggcaucuccuacgacggcuccgacaaguaccacaccaacuccgucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17026 - RNA, 432 nt, Artificial Sequence
  derived and/or modified sequence opt2 from anti-HIV_cap256-119-176241_VR-Chain
cagguccagcucgucgaguccggcggcggcgucguccagcccggccgcucccuccgccucuccugcgccgccuccggcuucaccuucuccaacuacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17027 - RNA, 432 nt, Artificial Sequence
  derived and/or modified sequence opt2 from anti-HIV_cap256-119-175215_VR-Chain
cagguccagcucgucgaguccggcggcggcgucguccagcccggccgcucccuccgccucuccugcgccgucucccaguucaccuucggccgcuacggcauguacuggguccgccaggcccccggcaagggccucgagugggucgccggcaucuccuacgacggcuccgacaaguaccacaccaacuccgucuggggccgcuucaucgucucccgcgacaacuccaagaacaugcucuaccuccagaugaacaaccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17028 - RNA, 432 nt, Artificial Sequence
  derived and/or modified sequence opt2 from anti-HIV_cap256-119-173928_VR-Chain
ggcgucgagcuccucgaguccggcggcggccucgucgagcccggcggcucccuccgccucuccugcgucggcucccaguucuccuucgaccgcuacggcaugcacuggguccgccaggcccccggcaagggccucgagugggucgccgccgucuccuucgacggcaccgacaaguaccacgccgacgacgucuggggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgaccucggcaagcagcuccccugccgcaagucccgcggcgucgccggcguccucgacaaguggggccucggcaccauggucaccgucuccucc

SEQ ID NO: 17029 - RNA, 432 nt, Artificial Sequence
  derived and/or modified sequence opt2 from anti-HIV_cap256-119-173495_VR-Chain
cagguccagcucgucgaguccggcggcggcgucguccagcccggcaagucccuccgccucuccugcgccgccucccgcuucaccuucaaccgcuacggcaugcacuggguccgccaggcccccggcaagggccucgagugggucgccgccaucuccuucgacggcaccgacaaguaccacuccgacgacgucuggggccgcuucaccaucucccgcgacaacuccaagaacacccucuaccuccagaugaacucccuccgcgccgaggacaccgccgucuacuacugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccucc

SEQ ID NO: 17030 - RNA, 432 nt, Artificial Sequence
  derived and/or modified sequence opt2 from anti-HIV_cap256-119-172882_VR-Chain
cagguccagcucgucgaguccggcggcggcgucguccagcccggccgcucccucacccucuccugcgaggucuccggcuucaccuucaagaccuacggcaugcacuggguccgccaggcccccggcaagggccucgagugggucgccuccaucuccuacgacggcuccgacaaguaccacgccgaccgcgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17031 - RNA, 432 nt, Artificial Sequence
  derived and/or modified sequence opt2 from anti-HIV_cap256-119-172429_VR-Chain
gagguccagcucgucgagaccggcggcggccucauccagcccggcggcucccuccgccucuccugcgucgccucccaguucaccuucuccggcugcggccuccacuggguccgccaggcccccggcaagggccucgagugggucgccuccaucuccuucgccggcaccaagaagcacuacggcaacuccgucaagggccgcuucaccaucucccgcgacaacuccaagaacacccucuaccucgagaugaacacccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucuccgucuccucc

SEQ ID NO: 17032 - RNA, 432 nt, Artificial Sequence
  derived and/or modified sequence opt2 from anti-HIV_cap256-119-172223_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaaggaccccugcgucaagccccgcggcgucgucggcguccucgacaucuggggccagggcacccucgucaccgucuccucc

SEQ ID NO: 17033 - RNA, 432 nt, Artificial Sequence
  derived and/or modified sequence opt2 from anti-HIV_cap256-119-171838_VR-Chain
cagguccagcucggcgaguccggcggcggcgucguccagcccggccgcucccuccgccucuccugcgccgccuccggcuucaccuucuccaccuucgccaugcacuggguccgccaggcccccggcaagggccucgagugggucgccgucaucuccuacgacggcuccaacaaguacuacgccgacuccgucaagggccgcuucgccaucucccgcgacaacgccaagaaccuccuccaccuccagaugaacucccuccgccccgaggacaccgcccucuacuacugcgccaaggaccuccaggaggacgagugcgaggaguggugguccgacuacuacgacuucggcaagcagcuccccugccgcaagucccgcggcgucgccggcaucuucgacgacuggggccagggcaccauggucaccgucuccucc

SEQ ID NO: 17034 - RNA, 432 nt, Artificial Sequence
  derived and/or modified sequence opt2 from anti-HIV_cap256-119-171587_VR-Chain
gagguccagcucgucgaguccggcggcggccucguccagcccggcggcucccuccgccucuccugcgccgccuccggcuucaccuucuccgacuacuacauguccuggauccgccaggcccccggcaagggccucgagugggucgccuccaucuccuucgccggcaccaagcagcacuacggcaacuccgucaagggccgcuucaccaucucccgcgacaacuccaagaacaccgucuaccuccagaugaacucccuccgccucgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17035 - RNA, 432 nt, Artificial Sequence
  derived and/or modified sequence opt2 from anti-HIV_cap256-119-169596_VR-Chain
cucguccagcucgucgaguccggcggcggcgucguccagcccggccgcucccuccgccucuccugcaccgccuccggcuucaccuucuccuccuucgccaugcaccgcguccgccagacccccggcaagggccucgagugggucgccuccaucuccuacgacggcuccgacaaguaccacgccgaccgcgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17036 - RNA, 432 nt, Artificial Sequence
  derived and/or modified sequence opt2 from anti-HIV_cap256-119-169523_VR-Chain
cagguccagcucgucgaguccggcggcggcgucguccagcccggcgagucccuccgccucuccugcgccgccuccggcuucuccuucggcaccuccgacguccacuggguccgccaggcccccggcgagggccucgagugggucgccuccaucuccuucgccggcaucaagaaguacuacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17037 - RNA, 432 nt, Artificial Sequence
  derived and/or modified sequence opt2 from anti-HIV_cap256-119-169462_VR-Chain
gagguccagcucgucgaguccggcggcggccucguccagcccggcggcucccuccgccucuccugcgccgccuccggcuucaccuucaccaccuacucccuccacuggguccgccagucccccggcaagggccucgagugggucgccgccaucuccuucgccggcaccaaggagaacuacgccaacuccguccgcggccgcuucaccaucucccgcgacaacuccaagaacacccucuaccuccagaugaacucccuccgcgccgaggacaccgcccucuacuacugcaccaaggacaugcgcgaguacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17038 - RNA, 432 nt, Artificial Sequence
  derived and/or modified sequence opt2 from anti-HIV_cap256-119-169092_VR-Chain
gagguccagcucgucgaguccggcggcggccucguccagcccggcggcucccuccgccucuccugcgucaucuccggcuucaccuucuccuccuacgagaugaacuggguccgccaggcccccggcaagggccucgagugggucgccggcaucuccuacgacggccgcgacaaguaccacgcccacuucgucuggggccgcaucaccaucucccgcgacaacuccaagaacacccucuaccuccagaugaacucccuccgcgccgaggacaccgcccucuaccacugcguccgcgaccuccgcgaguccgagugcgagcucugggaguccgacuacuacgacuucggcaagaagcuccccugcgucaagccccgcggcgucgccggcaucuucgaccucuggggccagggcaccauggucaccgucuccucc

SEQ ID NO: 17039 - RNA, 432 nt, Artificial Sequence
  derived and/or modified sequence opt2 from anti-HIV_cap256-119-168680_VR-Chain
cagguccagcucgucgaguccggcggcggcgucguccagcccggccgcucccuccgcgucuccugcgccgccucccacuucaccuucucccgcuacggcaugcacuggguccgccaggcccccggcaagggccucgagugggucgccuccaucuccuacgacggccgcgacuucuaccacgcccgcuccgucuggggccgcuucgccaucucccgcgacaacuccaagaacacccuccaccuccagaugaacucccuccgcaccgaggacaccgcccucuaccacugcguccgcgaccuccgcgaguccgagugcgagcucugggaguccgacuacuacgacuucggcaagaagcuccccugcgucaagccccgcggcgucgccggcaccuucgaccucuggggccagggcaccauggucaccgucuccucc

SEQ ID NO: 17040 - RNA, 438 nt, Artificial Sequence
  derived and/or modified sequence opt2 from anti-HIV_cap256-119-166385_VR-Chain
cagguccagcucgucgaguccggcggcggcgucguccaccccggccgcucccuccgccucuccugcgccgccuccggcuucuccuucggcaacuucggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17041 - RNA, 432 nt, Artificial Sequence
  derived and/or modified sequence opt2 from anti-HIV_cap256-119-165943_VR-Chain
gagguccagcucgucgaguccggcggcggccucguccagcccggccgcucccuccgccucuccugcgccgucuccggcuucaccgucuccuccaacuacauguccuggguccgccaggcccccggcaagggccucgagugggucgccuccaucuccuucgccggcaucaagaaguacuacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17042 - RNA, 432 nt, Artificial Sequence
  derived and/or modified sequence opt2 from anti-HIV_cap256-119-165738_VR-Chain
gagguccagcucgucgaguccggcggcggccucguccagcccggccgcucccuccgccucuccugcgccgccuccggcuucaccuucgacgacuacgccaugaacuggguccgccaggcccccggcaagggccucgagugggucgccaccaucuccuucgacggcaccgacaaguaccacgccgacgacgucuggggccgcuucaccaucucccgcgacaacuccaagaagacccucuaccuccagaugaacucccuccgcgccgaggacaccgcccucuacuacugcgccaaggaccuccgcgaggacgagugcgaggaguggugguccgacuacuacgaccucggcaagcagcuccccugccgcaagucccgcggcgucgccggcguccucgacaaguggggccucggcaccauggucaccgucuccucc

SEQ ID NO: 17043 - RNA, 432 nt, Artificial Sequence
  derived and/or modified sequence opt2 from anti-HIV_cap256-119-164913_VR-Chain
caggaccaccucgucgaguccggcggcggcggcguccagcccggcaagucccuccgccucuccugcgccgccuccggcuucaccuucuccgcccacgccaugcacuggguccgccaggcccccggcaagggccccgagugggucgccgucaucucccacgacggcggccagcaguucuaccgcgaguccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17044 - RNA, 432 nt, Artificial Sequence
  derived and/or modified sequence opt2 from anti-HIV_cap256-119-164167_VR-Chain
gagguccgccucgucgaguccggcggcggccucauccagcccggcggcucccuccgccucuccugcgccgccuccggccucaccgucuccuccaaccacauguccuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17045 - RNA, 432 nt, Artificial Sequence
  derived and/or modified sequence opt2 from anti-HIV_cap256-119-163558_VR-Chain
cagaugcagcucgucgaguccggcggcggcgucguccagcccggccgcucccucacccucuccugcgccgccucccaguucaacuucgccaacuacggcaugcacuggguccgccaggcccccggcaagggccucgagugggucgccuccaucuccuacgacggcuccgacaaguaccacgccgaccgcgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17046 - RNA, 432 nt, Artificial Sequence
  derived and/or modified sequence opt2 from anti-HIV_cap256-119-162043_VR-Chain
cagguccagcucgucgaguccggcggcggcgucguccagcccggccgcucccuccgcgucuccugcgccgccucccacuucaccuucucccgcuacggcaugcacuggguccgccaggcccccggcaagggccucgagugggucaccggcaucuccuucgccgccaccaagaccuacuacggcgacuccguccgcggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcauccucgaccucuggggccagggcaccauggucaccgucuccucc

SEQ ID NO: 17047 - RNA, 432 nt, Artificial Sequence
  derived and/or modified sequence opt2 from anti-HIV_cap256-119-161718_VR-Chain
cagguccagcucgucgaguccggcggcggcgucguccagcccggcaagucccuccgccucuccugcgccgccucccacuucuccuucaaccgcuacggcaugcacuggguccgccaggcccccggcaagggccucgagugggucgccgccaucuccuacgacggcaccgacaaguaccacgccgaccaggucuggggccgcuucaccaucucccgcgacaacuccaagaacacccucuaccuccagaugaacucccuccgccccgaggacaccgcccucuacuacugcgccaaggaccuccgcgaggacgagugcgaggaguggugguccgacuacuacgaccucggcaagcagcuccccugccgcaagucccgcggcgucgccggcaucuucgacaaguggggccagggcaccauggucaccgucuccucc

SEQ ID NO: 17048 - RNA, 432 nt, Artificial Sequence
  derived and/or modified sequence opt2 from anti-HIV_cap256-119-161675_VR-Chain
cagguccagcucgucgaguccggcggcggcgucguccagcccggccgcucccuccgccucuccugcaccgccuccggcuucaccuucuccaucuacuccaugaacuggguccgccaggcccccggcaagggccucgacugggucgccggcaucuccuucgccgccaccaagaccuacuacggcggcuccgucaagggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17049 - RNA, 432 nt, Artificial Sequence
  derived and/or modified sequence opt2 from anti-HIV_cap256-119-161053_VR-Chain
cagguccaccucgucgaguccggcggcggcgucguccagcccggcaccucccuccgccucuccugcgucgccuccggcuucaccuucuccaacuucgccaugcacuggguccgccaggcccccggcaagggccucgagugggccgccaucaucuccacccgcggcaacaaccgcaacuacgccgacuccguccgcggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcauccucgaccucuggggccagggcaccauggucaccgucuccucc

SEQ ID NO: 17050 - RNA, 432 nt, Artificial Sequence
  derived and/or modified sequence opt2 from anti-HIV_cap256-119-159499_VR-Chain
cagguccagcucgucgaguccggcggcggcgucguccagcccggccgcucccuccgccucuccugcgccgccuccggcuucgccuucucccacuacggcaucuucuggguccgccaggcccccggcaagggccucgagugggucgccuccaucuccuucgacggccgcgacuacuaccacuccccccacgucuggggccgccucaccaucucccgcgacaacuccaagaacacccucuaccuccagaugaacucccuccgcgccgaggacaccgcccucuacuacugcgcccgcgaccuccgcgaguccgagcgcgaggagugggaguccgacuacuacgacuucggcaagaagggccccugcgucaagccccgcggcgucgccggcucccucgacauguggggccagggcaccauggucaucgucuccucc

SEQ ID NO: 17051 - RNA, 432 nt, Artificial Sequence
  derived and/or modified sequence opt2 from anti-HIV_cap256-119-159114_VR-Chain
gagguccagcucgucgaguccggcggcggccucguccagcccggcggcucccuccgccucgccugcgccgccuccggccucaccuuccgcaagcacggcaugcacuggguccgccaggcccccggcaagggccucgagugggucuccuacaucuccuccgacggcgucaacaacuaccucaucgacuccguccgcggccgcuucaccgucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17052 - RNA, 432 nt, Artificial Sequence
  derived and/or modified sequence opt2 from anti-HIV_cap256-119-156751_VR-Chain
gagguccagcuccucgaguccggcggcggccucguccagcccggcggcucccuccgccucuccugcgccgccuccggcuucgccuucuccuccuacggcaugcacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17053 - RNA, 432 nt, Artificial Sequence
  derived and/or modified sequence opt2 from anti-HIV_cap256-119-155656_VR-Chain
gagguccagcucgucgaguccggcggcggccucguccagcccggcggcucccuccgccucuccugcgccgccuccggcaucaccuucuccuccuacggcaugcacuggguccgccaggcccccggcaagggccucgagugggucgccuucauccgcuacgacggcuccuccaaguacuacgccgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17054 - RNA, 432 nt, Artificial Sequence
  derived and/or modified sequence opt2 from anti-HIV_cap256-119-154420_VR-Chain
cagguccgccucgucgaguccggcggcggcgucguccagcccggccgcucccuccgcaucuccugcgccgccucccaguucauguucucccgcuacggcaugcacuggguccgccaggcccccggcaagggccucgagugggucgccuccaucuccuacgacggcaccgacaaguaccacgccgaccucgucuggggccgcuucaccaucucccgcgacaacuccaagaacacccucuaccuccagaugaacucccuccgcgccgaggacaccgcccucuacuacugcgcccgcgaccuccgcgaguccgagugcgaggagugggaguccgacuacuacgacuucggcaagaagggccccugcgucaagccccgcggcgucgccggcucccucgacauguggggccagggcaccauggucaucgucuccucc

SEQ ID NO: 17055 - RNA, 432 nt, Artificial Sequence
  derived and/or modified sequence opt2 from anti-HIV_cap256-119-153954_VR-Chain
gagguccagguccucgaguccggcggcggccucguccagcccggcggcucccuccgccucuccugcgucgccucccaguucaccuucuccggcugcggccuccacuggguccgccaggcccccggcaagggccucgagugggucgccuccaucuccuucgccggcaccaagaagcacuacggcaacuccgucaagggccgcuucaccaucucccgcgacaacuccaagaacaccgucuaccucgagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17056 - RNA, 432 nt, Artificial Sequence
  derived and/or modified sequence opt2 from anti-HIV_cap256-119-153864_VR-Chain
cagguccaccucgucgaguccggcggcggcgucguccagcccggcggcucccuccgccucuccugcgccgccuccggcuucaccuucuccggcugcggccuccacuggguccgccaggcccccggcaagggccucgagugggucgccuccaucuccuucgccggcaccaagaagcacuacggcuccuccguccgcggccgcuucuccaucucccgcgacaacuccaagaacacccucuaccuccagaugaacucccuccgcaccgaggacaccgcccucuacuucugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17057 - RNA, 432 nt, Artificial Sequence
  derived and/or modified sequence opt2 from anti-HIV_cap256-119-153793_VR-Chain
gagguccagcucgucgaguccggcggcggcgucguccagcccggcggcucccuccgccucuccugcgccaccuccggcuucaccuucggcaccuucggcaugcacuggguccgccaggcccccggcaagggccucgacugggucgccuacauccgcuacgacggcaagaccaagaacuacggcgaguccgucaagggccgcuucaccaucucccgcgacaacuccaagaacaccaugucccuccagaugaacucccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17058 - RNA, 432 nt, Artificial Sequence
  derived and/or modified sequence opt2 from anti-HIV_cap256-119-153462_VR-Chain
cagguccagcucgucgaguccggcggcggcgucguccagcccggcggcucccuccgccucuccugcgccgccuccggcuucaccuucuccaacuacggcaugcaguggguccgccaggcccccggcaagggccucgagugggucgccgccaucuccuacgacggccgcaacgaguacuacgccgaguccgucaagggccgcuucaccaucucccgcgacaacuucaaguccacccucuuccuccagaugaacucccuccgcgccgaggacaccgcccucuacuacugcgcccgcgaccuccgcgaguccgagugcgaggagugggaguccgacuacuacgccuucuaccgcaagcuccccugcgucaagccccgcggcgucgccggcacccucgacaucuggggccagggcaccauggucaccgucuccucc

SEQ ID NO: 17059 - RNA, 438 nt, Artificial Sequence
  derived and/or modified sequence opt2 from anti-HIV_cap256-119-153124_VR-Chain
cagguccagcucgucgaguccggcggcggcgucguccagcccggccgcucccucacccucuccugcaucgccucccaguucaacuucgccuccuacggcaugcacuggguccgccaggcccccggcaagggccucgagugggucgccuccaucucccacgacggcaccaagaaguaccacgccgaguccgucuggggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17060 - RNA, 438 nt, Artificial Sequence
  derived and/or modified sequence opt2 from anti-HIV_cap256-119-153025_VR-Chain
cagaugcagcucgucgaguccggcggcggcgucguccagcccggcaagucccucacccucuccugcgccgccucccaguucaccuucuccaacuacggcaugcacuggguccgccaggcccccggcaagggccucgagugggucgccuccaucuccaacgacggcaacaagaaguaccacggcgacuccgucuggggccgccucaccaucucccgcgacaacuccaagaacacccucuuccuccagaugaacucccuccgccccgaggacaccgcccucuacuucugcgucaaggaccagcgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17061 - RNA, 432 nt, Artificial Sequence
  derived and/or modified sequence opt2 from anti-HIV_cap256-119-152713_VR-Chain
gagguccagcucgucgaguccggcggcggccucguccgccccggcggcucccuccgccucuccugcgccaccuccggcuucaccuucuccucccacuggauguccuggguccgccaggcccccggcaagggccucgagugggucgccggcaucuccuucgccggcaccaagaccuacuacggcgacuccgucaagggccgcuucaccgucuccaccgacaucuccaagaacacccucuaccuccaggucaacucccuccgccccgaggacaccgccauguacuacugcgcccgcgaccagcgcuacuacgagugcgaggagugggccuccgacuacuacgacuucggcaaggagcagcccugccucgacccccgcggcgucgucggcaucuucgacaucuggggccagggcaccauggucaccgucuccucc

SEQ ID NO: 17062 - RNA, 438 nt, Artificial Sequence
  derived and/or modified sequence opt2 from anti-HIV_cap256-119-151794_VR-Chain
cacguccagcucgucgaguccggcggcggcgucguccagcccggcaccucccuccgccucuccugcgucgccuccgaguucuccuucaagaacuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17063 - RNA, 438 nt, Artificial Sequence
  derived and/or modified sequence opt2 from anti-HIV_cap256-119-150980_VR-Chain
cagguccagcucgucgaguccggcggcggcgucguccagcccggcaagucccuccgccucuccugcgccgccuccggcuucauccucuccaacuacgccaugcacuggguccgccaggcccccggcaagggccucgagugggucgccuccaucuccaacgacggcuccaagaaguaccacggcgacuccgucugggcccgcuucaucaucucccgcgacaacuccaagaacacccucuuccuccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17064 - RNA, 432 nt, Artificial Sequence
  derived and/or modified sequence opt2 from anti-HIV_cap256-119-148895_VR-Chain
cagguccagcucgucgaguccggcggcggcgucguccagcccggccgcucccuccgccucuccugcgccgccuccggcuucaccuuccgcuccuacggcaugcacuggguccgccaggcccccggcaagggccucgagugggucgccgucaucuccuccgacggcgacaucgaguacuacacccaguccgucaagggccgcuucaccaucucccgcgacaacuccaagaacacccucuaccuccagaugaacgcccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17065 - RNA, 438 nt, Artificial Sequence
  derived and/or modified sequence opt2 from anti-HIV_cap256-119-148848_VR-Chain
cagaugcagcucgucgaguccggcggcggcgucguccagcccggccgcucccucacccucuccugcgccgccucccaguucuccuucaccuccuacggcaugcacuggguccgccaggcccccggcaagggccucgagugggucgccuccaucuccaacgacggcaccaagaaguaccacggcgaguccgucugggaccgcuucuccaucucccgcgacaacuccaagaacacccucuuccuccagaugaacucccuccgcgucgaggacaccgcccucuacuucugcgucaaggaccagcgcgaggacgagugcgaggaguggugguccgacuacuacgacuucggcaaggagcuccccugccgcaaguggaagacccgcggcgucgccggcauccucgacaacuggggccagggcaccaugcucaccgucuccucc

SEQ ID NO: 17066 - RNA, 432 nt, Artificial Sequence
  derived and/or modified sequence opt2 from anti-HIV_cap256-119-148743_VR-Chain
cagguccagcucgucgaguccggcggcggcgucguccagcccggccgcucccucacccucuccugcgccgccucccaguucaacuucgccaacuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggcaagaagcuccccugccgcaagucccgcggccucgccggcaucuuccacgucuggggccacggcaccauggucaccgucuccucc

SEQ ID NO: 17067 - RNA, 432 nt, Artificial Sequence
  derived and/or modified sequence opt2 from anti-HIV_cap256-119-148595_VR-Chain
gagguccagcucgucgaguccggcggcggccucguccagcccggcggcucccuccgccucuccugcgccgccucccgcuucaccuucgacaacuacggcaugcacuggguccgccaggcccccggcaagggccucgagugggucgcccuccucaacuacgacggcuccaagaaguacuacgucgacuccgucaagggccgcuucaucaucuuccgcgacaacuccaagaacacccucuuccuccagaugaacucccuccgccccgaggacaccgcccucuacuucugcgucaaggaccagcgcgaggacgccugcgaggaguggugguccgacuacuacgacuucggcaagaagcuccccugccgcaagucccgcggccucgccggcaucuuccacgucuggggccacggcaccauggucaccgucuccucc

SEQ ID NO: 17068 - RNA, 432 nt, Artificial Sequence
  derived and/or modified sequence opt2 from anti-HIV_cap256-119-148490_VR-Chain
cagguccagcucgucgaguccggcggcggcgucguccagcccggccgcucccuccgccucuccugcgucgccuccggcuucaccuucuccgacuacgccaugcacuggguccgccaggcccccggcaagggccucgagugggucgccaccaucuccuucgacggcgccgacaaguaccacgccgacgacgucuggggccgcuucaccaucucccgcgacaacuccaagaacacccucuaccuccagaugaacucccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17069 - RNA, 438 nt, Artificial Sequence
  derived and/or modified sequence opt2 from anti-HIV_cap256-119-148470_VR-Chain
cagguccagcucgucgaguccggcggcggcgucguccagcccggccgcucccuccgccucuccugcgucgccuccggcuucaccuucuccuccuacggcauccacuggguccgccaggcccccggcaagggccucgagugggucgccgucaucuccgacgacggcuccaagaaguaccacgaggaguccgucuggggccgcuucaccaucuccaaggacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17070 - RNA, 432 nt, Artificial Sequence
  derived and/or modified sequence opt2 from anti-HIV_cap256-119-148107_VR-Chain
gagguccagcucgucgaguccggcggcggccucguccagcccggcggcucccuccgccucuccugcgccgccuccggcuucaccgucuccuccaacuacaugaccuggguccgccaggccccccgcaagggccucgagugggucggcuccaucuccuacgacggcuccgacaaguaccacaccaacucccucuggggccgcuucaucgucucccgcgacaacuccaagaacacccucuaccuccagaugaacaaccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17071 - RNA, 432 nt, Artificial Sequence
  derived and/or modified sequence opt2 from anti-HIV_cap256-119-147933_VR-Chain
gagcuccagcucgucgaguccggcggcggccucguccagcccggcuggucccuccgccucuccugcgaggccuccggcuuccccuucuccgccuucuggaugaccuggguccgccaggcccccggcaagggccucggcugggucgccuucauccgcuacgacggcuccaacaaguacuacgccgacuccgucaagggccgcuucaccaucucccgcgacaacuccaugaccacccucuaccuccagaugaacucccuccgcgccgaggacgccgccgucuacuacugcgccaaggaccuccgcgaggacgagugcgaggaguggugguccgacuacuacgacuucggcaagcgccuccccugccgcaagucccgcggcgucgccggcgucuucgacaaguggggccagggcaccauggucaccgucuccucc

SEQ ID NO: 17072 - RNA, 432 nt, Artificial Sequence
  derived and/or modified sequence opt2 from anti-HIV_cap256-119-147434_VR-Chain
cagguccagcucgucgaguccggcggcggcgucguccaggccggccgcucccuccgccucuccugcgccgccucccaguucaccuucggccgcuacggcaugcacuggguccgccaggcccccggcaagggccucgagugggucggcuccaucuccuacgacggcuccgacaaguaccacaccaacuccgucuggggccgcuucaucgucucccgcgacaacuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17073 - RNA, 435 nt, Artificial Sequence
  derived and/or modified sequence opt2 from anti-HIV_cap256-119-146106_VR-Chain
cagguccagcucgucgaguccggcggcggcgucguccagcccggccgcucccuccgccucuccugcgccgccuccggcuucaccuucuccuccuccggcaugcacuggguccgccaggcccccggcaagggccuccagugggucgccgucaucuccuacgacggcggcaacaaguacuacgccgacuccgucaagggccgcuucaccaucucccgcgacaacuccaagaacaaccucuaccuccagaugaacucccuccgccccgaggacaccgcccucuacuacugcgcccgcgaccuccgcgagauggagugcgaggaguggaagcucuacaacuacuacgacuuccgcacccgcggccccugcgucgacccccgcggcgucgucggcuccuucgacgucuggggccagggcaccgucgucaccgucuccucc

SEQ ID NO: 17074 - RNA, 438 nt, Artificial Sequence
  derived and/or modified sequence opt2 from anti-HIV_cap256-119-145604_VR-Chain
gacguccagcucgccgaguccggcggcggccucguccagcccggcggcucccuccgccucuccugcgucgccuccggcuucaccuucuccuccuucgagaugcacuggguccgccaggcccccggcaagggccucgagugggucgccuccaucuccaacgacggcaccaagcgcuaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17075 - RNA, 438 nt, Artificial Sequence
  derived and/or modified sequence opt2 from anti-HIV_cap256-119-143998_VR-Chain
cagguccagcucgucgaguccggcggcggcgucguccagcccggccgcucccuccgccucuccugcgccgccuccggcuucaccuuccgcaacuacggcaugcacuggguccgccaggcccccggcaagggccucgagugggucgccuccaucuccaacgacggcuccaagaaguaccacggcgacuccgucugggcccgcuucaucaucucccgcgacaacuccaagaacacccucuuccuccagauguccucccuccgcgccgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17076 - RNA, 438 nt, Artificial Sequence
  derived and/or modified sequence opt2 from anti-HIV_cap256-119-143441_VR-Chain
gagguccaccucgucgaguccggcggcggccucgcccagcccggccgcucccuccgccucuccugcgccgccucccaguucaacuucgccuccuacggcaugcacuggguccgccaggcccccggcaagggccucgagugggucgccuccaucuccaacgacggcaccaagcgcuaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17077 - RNA, 432 nt, Artificial Sequence
  derived and/or modified sequence opt2 from anti-HIV_cap256-119-141307_VR-Chain
cagguccaccucgucgaguccggcggcggcgucguccagcccggccgcucccuccgccucuccugcgccgccucccaguucaccuucaaccgcuacggccuccacuggguccgccaggcccccggcaagggccucgagugggucgccggcaucuccuacgacggccgcgacaaguaccacgcccacuucgucuggggccgcuucaucaucucccgcgacaacuccaagaacacccucuaccuccagaugaacucccuccgcgccgaggacaccgcccucuacuacugcguccgcgaccuccgcgaguccgagugcgagcucugggaguccgacuacuacgacuucggcaagcgccuccccugcgucaagccccgcggcgucgccggcaccuucgaccucuggggccagggcaccauggucaccgucuccucc

SEQ ID NO: 17078 - RNA, 432 nt, Artificial Sequence
  derived and/or modified sequence opt2 from anti-HIV_cap256-119-140896_VR-Chain
gaggucaagcucgucgaguccggcggcggccucguccagcccggcggcucccucaagcucuccugcgccgccuccggcuucaccuucuccuacuacgccaugcacuggguccgccaggcccccggcaagggccucgagugggucgccgucaucuccuacgacggcuccgacaaguacuacgccgacuccgucaagggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17079 - RNA, 432 nt, Artificial Sequence
  derived and/or modified sequence opt2 from anti-HIV_cap256-119-140090_VR-Chain
gagguccagcucgucgaguccggcggcggccucguccagcccggcggcucccuccgccucuccugcgccgccuccggcuucgccuucuccuccuacuggaugaccuggguccgccaggcccccggcaagggccucgagugggucgccgucaucuccuacgacggcuccaacaaguacuacgccgacuccguccgcggccgcuucaccaucucccgcgacuccuccaagaacacccucuaccucgagaugaacucccuccgccccgaggacaccgcccucuacuacugcgccaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17080 - RNA, 438 nt, Artificial Sequence
  derived and/or modified sequence opt2 from anti-HIV_cap256-119-140037_VR-Chain
cagguccagcucgucgaguccggcggcggccucguccagcccggccgcucccuccgccucuccugcgccgccuccggcuucaccuucgacgacuacgucaugcacuggguccgccaggcccccggcaagggccucgagugggucgccuccaucuccaacgacggcaccaagaaguaccacgaggaguccgucuggggccgcuucaccaucuccaaggacaacuccaaguccacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17081 - RNA, 432 nt, Artificial Sequence
  derived and/or modified sequence opt2 from anti-HIV_cap256-119-139135_VR-Chain
gagguccagcucgucgaguccggcggcggcgucguccgccccggcggcuccguccgccucuccugcgucgccuccggcuucuccuuccgcuccuacggcaugcacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17082 - RNA, 438 nt, Artificial Sequence
  derived and/or modified sequence opt2 from anti-HIV_cap256-119-137881_VR-Chain
cagguccagcucgucgaguccggcggcggccucgucaagcccggccgcucccucacccucuccugcgccgccucccaguucaccuucuccaacuacggcaugcacuggguccgccaggcccccggcaagggccucgagugggucgccuccaucuccaacgacggcaacaagaaguaccacggcgacuccgucugggcccgcuucaccaucucccgcgacaacuccaagaacacccucuuccuccagauguccucccuccgcaccgaggacaccgcccucuacuucugcguccgcgaccgccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17083 - RNA, 432 nt, Artificial Sequence
  derived and/or modified sequence opt2 from anti-HIV_cap256-119-137643_VR-Chain
gagguccagcucgucgaguccggcggcgaccucguccagcccggcggcucccuccgccucuccugcgccgccuccggcuucuccuucuccuccuacggcaugcacuggguccgccaggcccccgacaagggccucgagugggucaccgucaucuccuacgacggcuccaacaagcacuacgccgacuccgucaagggccgcuucaccaucucccgcgacaacuccaagaacacccucuaccucgagaugaacacccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucuccgucuccucc

SEQ ID NO: 17084 - RNA, 438 nt, Artificial Sequence
  derived and/or modified sequence opt2 from anti-HIV_cap256-119-137170_VR-Chain
cagguccagcucgucgaguccggcggcggcgucguccagcccggccgcucccuccgccucuccugcgccgccuccgaguucaccuucucccgcuacuccaugcacuggguccgccaggcccccggcaagggccucgagugggucgccgucaucuccuccgacggcuccaaccaguuccacgccgacuccgucuggggccgcuucaccaucuccaaggacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17085 - RNA, 432 nt, Artificial Sequence
  derived and/or modified sequence opt2 from anti-HIV_cap256-119-136616_VR-Chain
cagguccagcucgucgaguccggcggcggcgucguccagcccggccgcucccuccgccucuccugcgccgccuccggcuucaccuucucccgcaacgccaucaacuggguccgccaggcccccggccgcggccucgagugggucgccgucaucuccgacgacggcucccucaaguacuacgccgacuccgucaagggccgcuucaccaucucccgcgacaacuccaagaacacccucuaccuccagaugaacaaccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17086 - RNA, 432 nt, Artificial Sequence
  derived and/or modified sequence opt2 from anti-HIV_cap256-119-136206_VR-Chain
cagguccagcucgucgaguccggcggcggcgucguccagcccggccgcucccuccgccucuccugcgccgccucccaguucaccuucggccgcuacggcaugcacuggguccgccaggcccccggcaagggccucgagugggucgccgccaucuccuucgccggcaccaagaaguacuacggcgacuccgcccgcggccgcuucaccaucucccgcgacaacuccaagaacaugcucuuccuccagaugaacucccuccgcgccgaggacaccgcccucuacuacugcgcccgcgaccuccgcgacuacgagugcgaggagugggaggccuacuacuacgacuucggccgcgucggccccugcaccgacccccgcggcgucgucggcauccucgacgucuggggccagggcacccucgucaccgucuccucc

SEQ ID NO: 17087 - RNA, 438 nt, Artificial Sequence
  derived and/or modified sequence opt2 from anti-HIV_cap256-119-135565_VR-Chain
cagguccaccucgucgaguccggcggcggcgucguccagcccggcaagucccuccgccucuccugcgccgccucccaguucaccuucgaccgcuacggcaugcacuggguccgccaggcccccggcaagggccucgagugggucgccuccaucuccaacgacggcaccgacaaguaccacgccgacaacgucuggggccgcuucaccaucucccgcgacaacuccaagaacacccucuaccucgagaugaacucccuccgcggcgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17088 - RNA, 432 nt, Artificial Sequence
  derived and/or modified sequence opt2 from anti-HIV_cap256-119-135025_VR-Chain
gagguccagcucgucgaguccggcggcggccucguccagcccggcggcucccuccgccucuccugcgaggccuccggcuucaccuucaacaccuacgagaugaacuggguccgccagccccccggccgcggccucgagugggucgccggcaucuccuucgccgccaccaagaccuacuacggcggcuccgucaagggccgcuucaccgucucccgcgacaucuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17089 - RNA, 432 nt, Artificial Sequence
  derived and/or modified sequence opt2 from anti-HIV_cap256-119-133983_VR-Chain
cagaugcagcucgucgaguccggcggcggcgucguccagcccggccgcucccucacccucuccugcgccgccucccaguucaacuucgccaacuacggcaugcacuggguccgccaggcccccggcaagggccucgagugggucgccuccaucuccaacgacggcaccaagaaguaccacgaggaguccgucuggggccgcuucaccaucuccaaggacaacuccaagaacacccucuuccuccagaugaacucccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17090 - RNA, 438 nt, Artificial Sequence
  derived and/or modified sequence opt2 from anti-HIV_cap256-119-133917_VR-Chain
cagaugcagcucgucgaguccggcggcggcgucguccagcccggccgcucccucacccucuccugcgccgccucccaguucaccuucuccaacuacggcaugcacuggguccgccaggcccccggcaagggccucgagugggucgccuccaucuccaacgacggcuccaagaaguaccacggcgacuccgucugggcccgcuucaccaucucccgcgacaacuccaagaacacccucuuccuccagauguccucccuccgcgucgaggacaccgcccucuacuucugcguccgcgaccagcgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17091 - RNA, 432 nt, Artificial Sequence
  derived and/or modified sequence opt2 from anti-HIV_cap256-119-132663_VR-Chain
caggcccagcucgucgaguccggcggcggcgucguccagcccggccgcucccuccgcaucuccugcgccgucucccaguucaccuucucccgcuacggcaugcacuggguccgccaggcccccggcaagggccucgagugggucgccuccaucuccuucgacggccgcgacaaguaccacuccccccucgucuggggccgccucaccaucucccgcgacaacuccaagaacacccucuuccucgagaugaacucccuccgcgccgaggacaccgccgucuacuacugcgcccgcgaccuccgcgaguccgagugcgaggaguggcaguccgacuacuacgccuucuacaagaagcuccccugcgucaagccccgcggcgucgccggcucccucgacaucuggggccagggcaccgucgucaccgucuccucc

SEQ ID NO: 17092 - RNA, 438 nt, Artificial Sequence
  derived and/or modified sequence opt2 from anti-HIV_cap256-119-132113_VR-Chain
cagguccagcucgucgaguccggcggcggccucgucaagcccggcggcucccuccgccucuccugcgccgccucccaguucaacuucgccaacuacggcaugcacuggguccgccaggcccccggcaagggccucgagugggucgccuccaucuccaacgacggcaccaagaaguaccacgaggaguccgucuggggccgcuucaccaucuccaaggacaacuccaaguccacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17093 - RNA, 432 nt, Artificial Sequence
  derived and/or modified sequence opt2 from anti-HIV_cap256-119-131839_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17094 - RNA, 435 nt, Artificial Sequence
  derived and/or modified sequence opt2 from anti-HIV_cap256-119-130626_VR-Chain
gagguccagcucgucgaguccggcggcggccucauccaccccggcggcugccuccgccucuccugcgccgucuccggcuucaccuucuccgacuaccccaugcacuggguccgccagucccccggcaagggccucgagugggucgccgucaucuccuacgacggcaucaacuacuacuacgccgacuccgucaagggccgcuucaccaucucccgcgacaacuccaagaacaaccucuuccuccagaugaacucccuccgccucgaggacaccgcccucuacuacugcgcccgcgaccuccgcgagcucgacugcgaggaguggacccucuacaacuacuacgacuucggcucccgcggccccugcgucgacccccgcggcgucggcggcuccuucgacgucuggggccagggcaccauggucaccgucuccucc

SEQ ID NO: 17095 - RNA, 438 nt, Artificial Sequence
  derived and/or modified sequence opt2 from anti-HIV_cap256-119-130191_VR-Chain
gagguccagcucgucgaguccggcggcggccucauccagcccggccgcucccuccgccucuccugcgccgccuccggcuucaccgucuccuccaacuucaugaccuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17096 - RNA, 438 nt, Artificial Sequence
  derived and/or modified sequence opt2 from anti-HIV_cap256-119-129798_VR-Chain
cagguccagcucgucgaguccggcggcggcgucguccagcccggcaagucccuccgccucuccugcgccgccuccggcuucaucuucuccuccuacuucaugcacuggguccgccaggcccccggcaagggccucgagugggucgccgucgucaccgacgacggcuccaagaaguacuacgccgacuccgucaagggccgcuucaccaucucccgcgacuacuccaagaacacccucuuccuccagaugaaccgccuccgcgucgaggacaccgcccucuacuucugcgucaaggaccagcgcgaggacgagugcgaggaguggugguccgacuacuacgacuucggccgcgagcuccccugccgcaaguuccgcggccucggccucgccggcaucuucgacauguggggccacggcaccauggucaccgucuccucc

SEQ ID NO: 17097 - RNA, 432 nt, Artificial Sequence
  derived and/or modified sequence opt2 from anti-HIV_cap256-119-128745_VR-Chain
cagguccagcucgucgaguccggcggcggcgucguccagcccggccgcucccuccgccucuccugcgccgccuccggcuucaccuucuccaacuacgccaugcacuggguccgccaggcccccggcaagggccucgagugggucgccuccaucuccuucgccggcaccaagacccacuacggcaacuccgucaagggccgcuucuccaucucccgcgacaacuccaucaacaccgucuaccuccagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17098 - RNA, 438 nt, Artificial Sequence
  derived and/or modified sequence opt2 from anti-HIV_cap256-119-128593_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacaucuggggccacggcaccauggucaccgucuccucc

SEQ ID NO: 17099 - RNA, 438 nt, Artificial Sequence
  derived and/or modified sequence opt2 from anti-HIV_cap256-119-128152_VR-Chain
cagguccagcucgucgaguccggcggcggcgucguccagcccggccgcucccuccgccucuccugcgccgucuccggcuucaccuucaccuccuaccccaugcacuggguccgccaggcccccggcaagggccucgagugggucgccuccgucuccaacgacggcaccaagaaguaccacggcgacuccgucugggaccgcuucaccaucucccgcgacaacuccaagaacacccucuuccuccagauguccucccuccgcgccgaggacaccgccgucuacuucugcguccgcgacgagcgcgaggacgagugcgaggaguggugguccgacuacuacgacuucggccgcgagcuccccugccgcaaguuccgcggccucggccucgccggcaucuucgacaucuggggccacggcacccucgucaccgucuccucc

SEQ ID NO: 17100 - RNA, 438 nt, Artificial Sequence
  derived and/or modified sequence opt2 from anti-HIV_cap256-119-127693_VR-Chain
gagguccagcuccucgaguccggcggcggccucguccagcccggcggcucccuccgccucuccugcgccgccuccggcuucaccuucuccuccuacgccauggccuggguccgccaggcccccggcaagggccucgagugggucgccuccaucuccaacgacggcuccaagaaguaccacggcgacuccgucugggcccgcuucaucaucucccgcgacaacuccaagaacacccucuuccuccagauguccucccuccgcgucgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17101 - RNA, 432 nt, Artificial Sequence
  derived and/or modified sequence opt2 from anti-HIV_cap256-119-126684_VR-Chain
cagguccagcucgucgaguccggcggcggcgccguccgccccggccgcucccuccgccucuccugcgccaccuccggcuucaccuucuccaacuacgccaugcacuggguccgccaggcccccggcaagggccucgagugggucaccggcaucuccuucgccggcaccaagaccuacuacggcgacuccguccgcggccgcuucaccgucucccgcgacaucuccaagaacacccucuuccuccagaugaacucccuccgccccgacgacaccgccauguacuacugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 17102 - RNA, 438 nt, Artificial Sequence
  derived and/or modified sequence opt2 from anti-HIV_cap256-119-126056_VR-Chain
gagguccagcucgucgaguccggcggcggccucguccagcccggcggcucccuccgccucuccugcgccgacuccggcuucaccuucuccuccuacuggauguccuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17103 - RNA, 432 nt, Artificial Sequence
  derived and/or modified sequence opt2 from anti-HIV_cap256-119-125765_VR-Chain
cagguccagcucguccaguccggcggcggcgucguccagcccggccgcucccuccgccucuccugcgccgccuccggcuucaccuucuccuccuacgucaugcacuggguccgccaggcccccggcaagggccucgagggcgucgccgucaucuccuucgacggcaacaacgaguacuacgccgacuccgucaagggccgcuucaccaucucccgcgacaacuccaagaacaccgucuaccuccagaugaacucccuccgcgucgaggacaccgcccucuacuacugcgccaaggacaugcgcgaguacgagugcgaggaguggaccuccgacuacuacgacuucggccgcccccagcccugcaucgacucccgcggcgucgucggcauccucgacaucuggggccagggcaucauggucaccgucuccucc

SEQ ID NO: 17104 - RNA, 438 nt, Artificial Sequence
  derived and/or modified sequence opt2 from anti-HIV_cap256-119-125106_VR-Chain
cagguccagcucgucgaguccggcggcggcgucguccagcccggccgcucccuccgccucuccugcgccgccuccggcuucaucuuccgcuccuacggcaugcacuggguccgccaggcccccggcaagggccucgagugggucgccuccaucuccaacgacggcaccaagcgcuaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17105 - RNA, 435 nt, Artificial Sequence
  derived and/or modified sequence opt2 from anti-HIV_cap256-119-124026_VR-Chain
cagguccagcucgucgaguccggcggcggcgucguccaguccggccgcucccuccgccucaccugcuccggcuccgccuuccgcuucuccuccuacaccguccacuggguccgccaggcccccggcaagggccucgaguggcucgcccucaucuccuacgacggccagaagaagcacuucgccgacuccgucaagggccgcuucaccaucucccgcgacaacuccaagaacaaccucuuccuccagaugaacucccuccgccucgaggacaccgcccucuacuacugcgcccgcgaccuccgcgagcucgacugcgaggaguggacccucuacaacuacuacgacuucggcucccgcggccccugcgucgacccccgcggcgucggcggcuccuucgacgucuggggccagggcaccauggucaccgucuccucc

SEQ ID NO: 17106 - RNA, 432 nt, Artificial Sequence
  derived and/or modified sequence opt2 from anti-HIV_cap256-119-121783_VR-Chain
cucggccgccucgucgccuccggcggcggcgucgucccccccggcggcucccucacccucuccugcgucaccucccaguucaccuucuccggcugcggccuccacuggguccgccaggcccccggcaagggccucgagugggucgccuccaucuccuucgccggcaccaagaagcacuacggcuccuccguccgcggccgcuucuccaucucccgcgacaacuccaagaacacccucuaccuccagaugaacucccuccgcaccgaggacaccgcccucuacuucugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17107 - RNA, 432 nt, Artificial Sequence
  derived and/or modified sequence opt2 from anti-HIV_cap256-119-121208_VR-Chain
cucggccgccucgucgccuccggcggcggcgucgucccccccggcaagucccucacccucuccugcgucgccucccaguucaccuucuccggcugcggccuccacuggguccgccaggcccccggcaagggccucgagugggucgccuccaucuccuucgccggcaccaagaagcacuacggcaacuucguccgcggccgcuucaccaucucccgcgacaacuccaagaacacccucuaccuccagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17108 - RNA, 432 nt, Artificial Sequence
  derived and/or modified sequence opt2 from anti-HIV_cap256-119-120945_VR-Chain
cagguccagcucgucgaguccggcggcggcgucguccagcccggcggcucccuccgccucuccugcgucgccuccggcuucaccuucuccaacuacggcaugcacuggguccgccaggcccccggcaagggccucgccugggucgccuucauccgcuacgacggcuccaacaaguacuacgucgacuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaacaagggccccugcgucaagccccgcggcgucgucggcguccucgacaucuggggccagggcacccucgucaccgucuccucc

SEQ ID NO: 17109 - RNA, 432 nt, Artificial Sequence
  derived and/or modified sequence opt2 from anti-HIV_cap256-119-118229_VR-Chain
cagguccaggucgucgaguccggcggcggcgucguccagcccggccgcucccuccgccucuccugcgccgccuccggcuucaccuucuccaacuacgccauccacuggguccgccaggcccccggcaagggccucgagugggucgcccucaucuccuacgacggcuacaacaaguacuacgccgacuccguccgcggccgcuucaccaucucccgcgacaacuccaacaacaccgucuaccuccagaugaacucccucaagcccgaggacaccgccgucuacuacugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17110 - RNA, 432 nt, Artificial Sequence
  derived and/or modified sequence opt2 from anti-HIV_cap256-119-118025_VR-Chain
gagguccagcucgucgaguccggcggcggcgucguccagcccggcaagucccuccgccucuccugcaccgccucccaguucaccuucuccaacuucggcaugcacuggguccgccaggcccccggcaagggccucgagugggucgccuccaucuccuucgucggcaucaagacccacuacgccaacuccguccgcggccgcuucaccaucucccgcgaccaguccaagaacacccucuaccuccagaugaacuccguccgcaucgaggacaccgcccgcuacuucugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17111 - RNA, 432 nt, Artificial Sequence
  derived and/or modified sequence opt2 from anti-HIV_cap256-119-117418_VR-Chain
cagguccagcucgucgaguccggcggcggcgucguccagcccggccgcucccuccgccucuccugcgccgccuccggcuucaacuuccgcaacuacgacaucaacuggguccgccagguccccggcaagggccucgagugggucgccgccaucuccuucgacggcgccgacaaguaccacgccgacaacgucuggggccgccucuccaucucccgcgacaacuccaaguccacccucuaccuccagaugaacucccuccgccccgaggacaccgccgucuacuucugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccgcc

SEQ ID NO: 17112 - RNA, 432 nt, Artificial Sequence
  derived and/or modified sequence opt2 from anti-HIV_cap256-119-117250_VR-Chain
cagguccgccucgucgaguccggcggcggcgucguccagcccggcggcucccuccgccucuccugcgccgccucccaguucaccuucuccgccuacggcaugcacuggguccgccaggcccccggcaagggccucgagugggucgccuccaucuccuucgacggcaccgacaaguuccacgccgacaaggucuggggccgccucgucaucucccgcgacaacuccaagaacacccucuaccuccagaugaacucccuccgccccgaggacaccgccgucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17113 - RNA, 432 nt, Artificial Sequence
  derived and/or modified sequence opt2 from anti-HIV_cap256-119-117230_VR-Chain
cagguccagcucgucgaguccggcggcggcggcguccagcccggccgcucccuccgccucuccugcgccgccuccggcuucacccucuccuccuacggcaugcacuggguccgccaggcccccggcaagggccucgagugggucgccuccaucuccuucgacggccgcgacuacuaccacuccccccacgucuggggccgccucaccaucucccgcgacaacuccaagaacacccucuaccuccagaugaacucccuccgcgccgaggacaccgcccucuacuacugcgcccgcgaccuccgcgaguccgagugcgaggagugggaguccgacuacuacgacuucggcaagaagggccccugcgucaagccccgcggcgucgccggcucccucgacauguggggccagggcaccauggucaucgucuccucc

SEQ ID NO: 17114 - RNA, 432 nt, Artificial Sequence
  derived and/or modified sequence opt2 from anti-HIV_cap256-119-116999_VR-Chain
cagguccagcucgucgaguccggcggcggcgucguccagcccggcaccucccuccgcaucuccugcgccgccucccaguucaccuucucccgcuacggcaugcacuggguccgccaggcccccggcaagggccucgagugggucgccuccaucuccuacgacggccgcgacuacuaccacgccggccgcgucuggggccgcuucaccaucucccgcgacaacuccaagaacacccucuaccuccagaugaacucccuccgccccgaggacaccgcccucuacuucugcguccgcgacucccgcgaguccgagugcgaggagugggaguccgacuacuacgacuucggcaagaagcuccccugcgucaagccccgcggcgucgucggcguccucgaccucuggggccagggcacccucgucaccgucuccucc

SEQ ID NO: 17115 - RNA, 432 nt, Artificial Sequence
  derived and/or modified sequence opt2 from anti-HIV_cap256-119-116558_VR-Chain
cagguccagcucgucgaguccggcggcggcgucguccagcccggccgcucccuccgccucuccugcgccgccuccggcuucaccuucaaccgcuacucccuccacuggguccgccaggcccccggcaagggccucgagugggucgccuucaccuccuacgacggcuccaacaaguacuaccccgacuccgucaagggccgcuucaccaucucccgcgacuccuccaagaacacccucuaccucgagaugaacucccuccgccccgaggacaccgcccucuacuacugcgccaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17116 - RNA, 432 nt, Artificial Sequence
  derived and/or modified sequence opt2 from anti-HIV_cap256-119-116484_VR-Chain
gacguccagcuccucgaguccggcggcgaccucguccagcccggcggcucccuccgccucuccugcgccgccuccggcuucaccuucaccaaguacgagaugaccuggguccgccaggcccccggcaagggccucgagugggucgccuccaucuccuacgacggcuccgacaaguaccacaccuccucccucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17117 - RNA, 438 nt, Artificial Sequence
  derived and/or modified sequence opt2 from anti-HIV_cap256-119-114844_VR-Chain
gagguccagcucgucgaguccggcggcgaccucguccagcccggccgcucccuccgccucuccugcgccgccuccggcuucaccuucuccuccuacuggauguccuggguccgccaggcccccggcaagggccucgagugggucgccuccaucuccaacgacggcaccaagaaguaccacgaggaguccgucuggggccgcuucaccaucuccaaggacaacuccaaguccacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17118 - RNA, 438 nt, Artificial Sequence
  derived and/or modified sequence opt2 from anti-HIV_cap256-119-114141_VR-Chain
ggcggccgcuccggcggcggcggcgucggcaccaccccccgccgcggcccccuccgccucuccugcgccgccuccggcuucacccucgacgacuacgccaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgucuucugggagcgcgcccccugccgcaccguccccggccgcggccccggcugguacuucgacauggucggccgccgcaccauggucaccgucuccucc

SEQ ID NO: 17119 - RNA, 432 nt, Artificial Sequence
  derived and/or modified sequence opt2 from anti-HIV_cap256-119-111917_VR-Chain
gagguccaccucgucgaguccggcggcggccucguccagcccggcggcucccuccgccucuccugcgccgccuccggcuucaccuucuccuccuacggcaugcacuggguccgccaggcccccggcaagggccucgagugggucgccaccaucuccuucgacggcgccgacaaguaccacgccgacgacgucuggggccgcuucuccaucucccgcgacaacuccaagaacacccucuaccuccagaugaacaaccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17120 - RNA, 432 nt, Artificial Sequence
  derived and/or modified sequence opt2 from anti-HIV_cap256-119-111862_VR-Chain
cagguccagcucgucgaguccggcggcggcgucguccagcccggcggcucccuccgccucuccugcgccgccuccggcuucaccuacuccgacuacggcaugcacuggguccgccaggcccccggcaagggccucgagugggucgccuccaucuccuucgccggcaccaagcagcacuacggcaacuccgucaagggccgcuucaccaucucccgcgacaacuccaagaacaccgucuaccuccagaugaacucccuccgcgucgaggacaccgcccucuacuacugcgccaaggacaugcgcgaguacgagugcgaggaguggaccuccgacuacuacgacuucggccgcccccagcccugcaucgacucccgcggcgucgucggcauccucgacaucuggggccagggcaucauggucaccgucuccucc

SEQ ID NO: 17121 - RNA, 432 nt, Artificial Sequence
  derived and/or modified sequence opt2 from anti-HIV_cap256-119-110064_VR-Chain
cucggccgccucgucgccuccggcggcggcgucgucccccccggccgcucccuccgccucuccugcgucgccucccaguucaccuucuccggcugcggccuccacuggguccgccaggcccccggcaagggccucgagugggucgccuccaucuccuucgccggcaccaagcagcacuacggcaacuccgucaagggccgcuucaccaucucccgcgacaacuccaagaacaccgucuaccuccagaugaacucccuccgcgucgaggacaccgcccucuacuacugcgccaaggacaugcgcgaguacgagugcgaggaguggaccuccgacuacuacgacuucggccgcccccagcccugcaucgacucccgcggcgucgucggcauccucgacaucuggggccagggcaccauggucaccgucuccuuc

SEQ ID NO: 17122 - RNA, 432 nt, Artificial Sequence
  derived and/or modified sequence opt2 from anti-HIV_cap256-119-109192_VR-Chain
cagguccagcucgucgaguccggcggcggcgucguccagcccggccgcucccuccgccucuccugcgccgccuccggcuucaccuucuccaacuacgccaugcacuggguccgccaggcccccggcaagggccucgagugggucgccgucaucgccuacgacggcgacaacaaguacuacgccgacuccgucaagggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgaccucggcaagcagcuccccugccgcaagucccgcggcgucgccggcguccucgacaaguggggccucggcaccauggucaccgucuccucc

SEQ ID NO: 17123 - RNA, 435 nt, Artificial Sequence
  derived and/or modified sequence opt2 from anti-HIV_cap256-119-108793_VR-Chain
caguuccagcucgucgaguccggcggcggcgucguccagcccggccgcucccuccgccucuccugcgccgccuccggcuucaccuucuccuccuaccccaugcacuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccgucuaccacugcgccaaggaccucggcggcuccaaguccgacgagugggccaccgacuacuacuacgacugguccaaggccuaccccguccacgacccccgcgccgucgucggcgucuucgacaucuggggccagggcacccucgucaccgucuccucc

SEQ ID NO: 17124 - RNA, 432 nt, Artificial Sequence
  derived and/or modified sequence opt2 from anti-HIV_cap256-119-108127_VR-Chain
cagguccagcucgucgaguccggcggcggcgucguccagcccggccgcucccuccgcaucuccugcgccgccucccaguucaccuucaaccgcuacggcaugcacuggguccgccaggcccccggcaagggccucgagugggucgccuccaucuccuacgacggcuccgacaaguaccacgccggccucgucuggggccgcuucaucaucucccgcgacaacuccaagaacacccucuaccuccagaugaacucccuccgcgccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17125 - RNA, 438 nt, Artificial Sequence
  derived and/or modified sequence opt2 from anti-HIV_cap256-119-107758_VR-Chain
gagguccagcucgucgaguccggcggcggccucgucaagcccggcggcucccuccgccucuccugcgccgccuccggcuucaccuucuccaacgccuggauguccuggguccgccaggcccccggcaagggccucgagugggucgccuccaucuccaacgacggcaccaagaaguaccacgaggaguccgucuggggccgcuucaccaucuccaaggacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17126 - RNA, 432 nt, Artificial Sequence
  derived and/or modified sequence opt2 from anti-HIV_cap256-119-107209_VR-Chain
gagguccagcucgucgaguccggcggcggccucguccagcccggccgcucccuccgccucuccugcaccgccuccggcuucaccuucggcgacuacggcaugcacuggguccgccaggcccccggcaagggccucgagugggucgccgccaucuccuucgacggcgccgacaaguaccacgccgacaacgucuggggccgccucuccaucucccgcgacaacuccaaguccacccucuaccuccagaugaacucccuccgccccgaggacaccgccgucuacuucugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccgcc

SEQ ID NO: 17127 - RNA, 432 nt, Artificial Sequence
  derived and/or modified sequence opt2 from anti-HIV_cap256-119-107184_VR-Chain
caggcccagcucgucgaguccggcggcggcgucguccagcccggccgcucccucggccucuccugcgccgccuccaaguucucccucuccuccuacggcaugcacuggguccgccaggcccccggccgcggccucgagugggucgccggcaucuccuucgccggcaccaagaaguacuacgccgacuccguccgcggccgcuucuccgucuccaccgacaucuccaagaacacccucuaccuccagaugaacucccuccgccccgccgacaccgcccucuacuucugcgcccgcgaccuccgcuacuacgagugcgaggagugggccuccgacuacuacgacuucggcaaggagcagcccugccucgacccccgcggcgucgucggcaucuucgaccucuggggccagggcaccauggucaccgucuccucc

SEQ ID NO: 17128 - RNA, 438 nt, Artificial Sequence
  derived and/or modified sequence opt2 from anti-HIV_cap256-119-106827_VR-Chain
gccguccagcucgucgaguccggcggcggccucguccagcccggcggcucccuccgccucuccugcuccgucucccaguucaccuucggccgcuacggcauguacuggguccgccaggcccccggcaagggccucgagugggucgccgucaucuccuacgacggcggcaaccgcuacuacgccgacuccgucaagaaccgcuucuccaucucccgcgacaacuccaagaacacccucuuccuccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17129 - RNA, 432 nt, Artificial Sequence
  derived and/or modified sequence opt2 from anti-HIV_cap256-119-106511_VR-Chain
cagguccagcucgucgaguccggcggcggcgucguccagcccggccgcucccuccgccucuccugcgucgccucccaguucuccuucgaccgcuacggcaugcacuggguccgccaggcccccggcaagggccucgagugggucgccuccaucuccuucgacggcaccgacaaguaccacgccgacaaggucuggggccgcuucaccaucucccgcgacaacuccaagaacacccucuaccuccagaugaacucccuccgccccgaggacaccgcccucuacuacugcgccaaggacaugcgcgaggacgagugcgaggccuggugguccgacuacuacgaccucggcaagcagcuccccugccgcgagucccgcggcgucgccggcaucuucgacgaguggggccagggcaccauggucaccgucuccucc

SEQ ID NO: 17130 - RNA, 432 nt, Artificial Sequence
  derived and/or modified sequence opt2 from anti-HIV_cap256-119-106327_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgccaucuccggcggcggcggcaacaccuacgucgccgacuccgucaagggccgcuucaccaucucccgcgacaacuccaagaacaccgucuaccuccagaugaacucccuccgccucgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17131 - RNA, 438 nt, Artificial Sequence
  derived and/or modified sequence opt2 from anti-HIV_cap256-119-105486_VR-Chain
cagguccagcucgucgaguccggcggcggcgucguccagcccggcggcucccuccgccucuccugcgccgccuccggcuucaccgucuccggcuacggcaugcacuggguccgccaggcccccgccaagggccucgacugggucgccuucaucucccacgacggcuccaacaaguacuacgccgacuccguccgcggccgcuucaucaucucccgcgacaacuccaacaacacccucuacguccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17132 - RNA, 432 nt, Artificial Sequence
  derived and/or modified sequence opt2 from anti-HIV_cap256-119-105197_VR-Chain
cagguccagcucgucgaguccggcggcggcgucguccagcccggccgcucccuccgccucuccugcgccgucucccaguucaccuucggccgcuacggcaugcacuggguccgccaggcccccggcaagggccucgagugggucggcuccaucuccuacgacggcuccgacaaguaccacaccaacucccucuggggccgcuucaucgucucccgcgacaacuccaagaacacccucuaccuccagaugaacaaccuccgccccgaggacaccgcccucuacuacugcguccgcgaccgccgcgaguccgagugcgaggagcgcugguccgacuacuacgacuucggcaagcagcuccccugcgucaagccccgcggcgucgucggcguccucgacaucuggggccagggcacccucgucaccgucuccucc

SEQ ID NO: 17133 - RNA, 432 nt, Artificial Sequence
  derived and/or modified sequence opt2 from anti-HIV_cap256-119-104946_VR-Chain
caggagcagcucgucgaguccggcggcggcgucguccagcccggccgcucccuccgccucuccugcgucgccucccgcuucaccuucuccgccuucggcaugcacuggguccgccaggcccccggcaagggccucgagugggucgccuccaucuccuucgccggcaucaagaaguacuacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugcaucgacucccgcggcgucgucggcauccucgacaucuggggccagggcaucauggucaccgucuccucc

SEQ ID NO: 17134 - RNA, 432 nt, Artificial Sequence
  derived and/or modified sequence opt2 from anti-HIV_cap256-119-103667_VR-Chain
cagguccaccucgucgaguccggcggcggcgucguccagcccggcaagucccuccgccucuccugcgccgccucccaguucaccuucaaccgcuucggcaugcacuggguccgccaggcccccggcaagggccucgagugggucgccggcaucuccuacgacggcuccgacaaguaccacgccgacaaggucuggggccgcuucaccaucucccgcgacaacuccaagaacacccucuaccuccagaugaacucccuccgcgccgaggacaccgcccucuacuacugcgccaaggaccuccgcgaggacgagugcgaggagugggccuccgacuacuacgacuucggcaaggagcagcccugccucgacccccgcggcgucgucggcaucuucgacaucuggggccagggcaccauggucaccgucuccucc

SEQ ID NO: 17135 - RNA, 438 nt, Artificial Sequence
  derived and/or modified sequence opt2 from anti-HIV_cap256-119-103385_VR-Chain
gagguccagcucgucgaguccggcggcggccucguccagaccggcggcucccuccgccucuccugcgccgccuccggcuucaccuucucccgcuacgacaugaacuggguccgccaggcccccggcaagggccucgagugggucgccuccaucuccaacgacggcuccaagaaguaccacggcgacuccgucugggcccgcuucaccaucucccgcgacaacuccaagaacacccucuuccuccagauguccucccuccgcgucgaggacaccgcccucuacuucugcguccgcgaccagcgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17136 - RNA, 438 nt, Artificial Sequence
  derived and/or modified sequence opt2 from anti-HIV_cap256-119-103267_VR-Chain
gagguccccuccgucgaguccggcggcggccucguccagaccggcggcucccucacccucuccugcgccgccucccaguucaccuucuccaacuacggcaugcacuggguccgccaggcccccggcaagggccucgagugggucgccuccaucuccaacgacggcuccaagaaguaccacggcgacuccgucugggcccgcuucaucaucucccgcgacaacuccaagaacacccucuuccuccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17137 - RNA, 432 nt, Artificial Sequence
  derived and/or modified sequence opt2 from anti-HIV_cap256-119-103011_VR-Chain
cagguccagcucgucgaguccggcggcggcgucguccagcccggcggcucccuccgccucuccugcgccaccuccggcuucaccuucggcaccuucggcaugcacuggguccgccaggcccccggcaagggccucgacugggucgccgccaucuccuucgccggcaccaagaagaacuacgccgacuccguccgcggccgcuucaccaucucccgcgacuccuccaagaacacccucuaccuccagaugaacucccuccgccccgaggacaccgcccucuacuacugcgucaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17138 - RNA, 438 nt, Artificial Sequence
  derived and/or modified sequence opt2 from anti-HIV_cap256-119-102072_VR-Chain
gagguccagcucgucgaguccggcggcggccucguccagcccggcggcucccuccgcgucuccugcgccgucuccggcuucaccuucuccaacuacgagaugaacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacaucuggggccacggcaccauggucaccgucuccucc

SEQ ID NO: 17139 - RNA, 438 nt, Artificial Sequence
  derived and/or modified sequence opt2 from anti-HIV_cap256-119-101945_VR-Chain
gagguccagcucgucgaguccggcggcggccucguccagcccggcggcucccuccgccucuccugcgccgccuccggcuucaccuucuccuccuacgucaugcacuggguccgccaggcccccggcaagggccucgagugggucgccuccaucuccaacgacggcaccaagaaguaccacgaggaguccgucuggggccgcuucaccaucuccaaggacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17140 - RNA, 432 nt, Artificial Sequence
  derived and/or modified sequence opt2 from anti-HIV_cap256-119-101319_VR-Chain
cagguccagcucgucgaguccggcggcggcgucguccagcccggcaagucccuccgccucuccugcgucggcuccggcuucaccuucgacgacuacggcaugcacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17141 - RNA, 432 nt, Artificial Sequence
  derived and/or modified sequence opt2 from anti-HIV_cap256-119-100871_VR-Chain
cagguccagcucgucgaguccggcggcggcgucguccagcccggcgagucccuccgcaucuccugcgccgccucccaguucaccuucucccgcuacggcaugcacuggguccgccaggcccccggcaagggccucgagugggucgccuccaucuccuucgacggccgcgacaaguaccacuccucccucgucuggggccgccucaccaucucccgcgacaacuccaaguccacccucuuccuccagaugaacucccuccgcgccgaggacaccgcccucuacuacugcgcccgcgaccuccgcgaguccgagugcgaggagugggaguccgacuacuacgacuucggcaagccccagcccugcgaggacccccgcggcgucgucggcaccuucgacauguggggccucggcacccucgucaccgucuccucc

SEQ ID NO: 17142 - RNA, 432 nt, Artificial Sequence
  derived and/or modified sequence opt2 from anti-HIV_cap256-119-100838_VR-Chain
gagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaaccacacccucuacaugcagcucgacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17143 - RNA, 438 nt, Artificial Sequence
  derived and/or modified sequence opt2 from anti-HIV_cap256-119-100025_VR-Chain
cagguccagcucgucgaguccggcggcggcgucguccagcccggccgcucccuccgccucuccugcgccgccuccgucuucaccuucuccuacuacggcaugcacuggguccgccaggcccccggcaagggccucgagugggucgccuucaucucccacgacggcuccaacaaguacuacgccgacuccguccgcggccgcuucaucaucucccgcgacaacuccaacaacacccucuacguccagaugaacucccuccgcgccgaggacaccgcccucuacuucugcgucaaggaccagcgcgaggacgagugcgaggaguggugguccgacuacuacgacuucggccgcgagcuccccugccgcaaguuccgcggccucggccucgccggcaccuucgacaucuggggccacggcaccaugcucaucgucuccucc

SEQ ID NO: 17144 - RNA, 432 nt, Artificial Sequence
  derived and/or modified sequence opt2 from anti-HIV_cap256-119-100000_VR-Chain
cagaugcagcucgucgaguccggcggcggcgucguccagcccggccgcucccucacccucuccugcgccgccucccaguucaccuucuccaacuacggcaugcacuggguccgccaggcccccggcaagggccucgagugggucgccuccaucuccaacgacggcaacaagaaguaccacggcgacuccgucugggcccgcuucaccaucucccgcgacaacuccaagaacacccucuuccuccagauguccucccuccgcaccgaggacaccgcccucuacuucugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17145 - RNA, 432 nt, Artificial Sequence
  derived and/or modified sequence opt2 from anti-HIV_cap256-119-098890_VR-Chain
cagguccagcucgucgaguccggcggcggcgucguccagcccggcgagucccuccgcaucuccugcgucgccucccaguucaccuucggccgcuacggcaugcacuggguccgccaggcccccggcaagggccucgagugggucgccuccaucuccuucgacggccgcgacaaguaccacuccccccucgucuggggccgccucaccaucucccgcgacaacuccaagaacacccucuuccuccagaugaacucccuccgcaccgaggacaccgcccucuacuacugcgcccgcgaccuccgcgaguccgagugcgaggagugggaguccgacuacuacgccuucuggcgcaagcuccccugcgucaagccccgcggcgucgccggcacccucgacaucuggggccagggcaccauggucuccgucuccucc

SEQ ID NO: 17146 - RNA, 435 nt, Artificial Sequence
  derived and/or modified sequence opt2 from anti-HIV_cap256-119-098715_VR-Chain
cagguccagcucgucgaguccggcggcggcgucguccagcccggccgcucccuccgccucuccugcgccgccuccggcuucuccuucaacaaccacggcaugcacuggguccgccaggcccccggcaagggccucgagugggucgccggcaucuccuucgccggcaucaagaaguacuacggcaccuccgucaagggccgcuucaccaucucccgcgacaacuccaagaacaaccucuuccuccagaugaacucccuccgcgucgaggacaccgcccucuacuacugcgcccgcgaccuccgcgagauggagugcgaggaguggacccucuacaacuacuacgacuucggcucccgcggccccugcgucgacccccgcggcgucgucggcuccuucgacgucuggggccagggcaccauggucaccgucuccucc

SEQ ID NO: 17147 - RNA, 438 nt, Artificial Sequence
  derived and/or modified sequence opt2 from anti-HIV_cap256-119-098632_VR-Chain
cagaugcagcucgucgaguccggcggcggcgucguccagcccggccgcucccucacccucuccugcgccgccucccaguucaacuucgccaacuacgacaugcacuggguccgccaggcccccggcaagggccucgagugggucgccuucauccgcuacgacggcaacaacaaguacuacgccgacuccgucaagggccgcuucaccaucucccgcgacaacuccaaguccacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17148 - RNA, 432 nt, Artificial Sequence
  derived and/or modified sequence opt2 from anti-HIV_cap256-119-097199_VR-Chain
cagguccagcucgucgaguccggcggcggcgucguccagcccggccgcucccuccgccucuccugcgccgccuccggcuucgccuucuccuccuacgccuuccacuggguccgccaggcccccggcaagggccucgagugggucgccuacauccccuuccacggcaaccagcaguacuacggcgacuccgucaagggccgcuucaccaucucccgcgacaacucccgcgacacccucuuccucgagaugaacucccuccgccccgaggacaccgcccucuacuucugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 17149 - RNA, 432 nt, Artificial Sequence
  derived and/or modified sequence opt2 from anti-HIV_cap256-119-096189_VR-Chain
cagguccagcucgucgaguccggcggcggcgucguccagcccggccgcucccuccgccucuccugcgccgccuccggcuucaaguucggcuccuucggcaugcacuggguccgccaggcccccggcaagggccucgagugggucgccgucaucuccuacgacggcuccgacaaguacuacggcuccuccguccgcggccgcuucuccaucucccgcgacaacuccaagaacacccucuaccuccagaugaacucccuccgcaccgaggacaccgcccucuacuucugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17150 - RNA, 432 nt, Artificial Sequence
  derived and/or modified sequence opt2 from anti-HIV_cap256-119-094581_VR-Chain
cagguccaccucgucgaguccggcggcggcgucguccagcccggccgcucccuccgccucuccugcgccgccuccggcuucaacuucuccaacuacgccauccacuggguccgccagacccccggcaagggccucgagugggucacccucaucuccaacgacggcuccaacaaguacuacgccgacucccucaagggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggcaagcagcuccccugccgcaagucccgcggcgucgccggcaucuucgacggcuggggccagggcaccauggucaccgucuccucc

SEQ ID NO: 17151 - RNA, 432 nt, Artificial Sequence
  derived and/or modified sequence opt2 from anti-HIV_cap256-119-094200_VR-Chain
gagguccagcucgucgaguccggcggcggccucguccagcccggcggcucccuccgccucuccugcgccgccuccggcuucaucuucuccuccuacgcccuccacuggguccgccaggcccccggcaagggccucgagugggucgccuccaucuccuucgccggcaccaagaaccacuacggcaacuccgucaagggccgcuucaccaucucccgcgacaacuccaagaacaccgucuaccuccagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17152 - RNA, 432 nt, Artificial Sequence
  derived and/or modified sequence opt2 from anti-HIV_cap256-119-094158_VR-Chain
cagaugcagcucgucgaguccggcggcggcgucguccagcccggcuccucccucacccucuccugcgccgccucccaguucaccuucuccaacuacggcaugcacuggguccgccaggcccccggcaagggccucgagugggucgccuccaucuccaacgacggcaccaagaaguaccacggcgacuccgucugggaccgcuucaccaucucccgcgacaacuccaagaacacccucuuccuccagaugaacucccuccgcgccgaggacaccgcccucuacuucugcgucaaggaccagcgcgaggacgagugcgaggaguggugguccgacuacuacgacuucggcaagcagcuccccugccgcaagucccgcggcgucgccggcaucuucgacuccuggggccagggcaccauggucaccgucuccucc

SEQ ID NO: 17153 - RNA, 432 nt, Artificial Sequence
  derived and/or modified sequence opt2 from anti-HIV_cap256-119-092814_VR-Chain
cagguccagcucgucgaguucggcggcggcgucguccagcccggcggcucccuccgccucuccugcgccgccuccggcuucuacuucaccgacuacggcaugcacuggguccgccaggcccccggcgagggccuccagugggucgccuucaucuccuacgacggcaacaccaagaccaccgccgacuccguccgcggccgcuucacccucucccgcgacaacuccaagaacacccucuaccuccagaugaacuccguccgcgucgaggacaccgcccgcuacuucugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17154 - RNA, 432 nt, Artificial Sequence
  derived and/or modified sequence opt2 from anti-HIV_cap256-119-092808_VR-Chain
cagguccagcucgucgaguccggcggcggcgucguccagcccggccgcucccuccgccucuccugcgccgccucccaguucuccuucggcaacuacggcaugcacuggguccgccaggcccccggcaagggccucgagugggucgccgccaucuccuucgccggcaccaagaccaacuacgccgacuccgucaagggccgcuucaccaucucccgcgacaacuccaagaacaccgucuaccuccagaugaacucccuccgcgccgaggacaccgcccucuacuucugcgccaaggacauccgcgaguacgagugcgaguacuggaccuccgacuacuacgacuucggccgcccccagcccugcaucgacucccgcggcgucgucggcaccuucgacgucuggggccagggcaccauggucaccgucuccucc

SEQ ID NO: 17155 - RNA, 432 nt, Artificial Sequence
  derived and/or modified sequence opt2 from anti-HIV_cap256-119-092573_VR-Chain
caggagcagcucgucgaguccggcggcggcgucguccagcccggcaccucccuccgccucuccugcuccgccuccggcuucaccuucuccaacuucgccaugaacuggguccgccaggcccccggcaagggccucgagugggucuccuucaucuccuccgacggcaagaacaagaacuacgucgacuccgucaagggccgcuucaccaucucccgcgacaacuacaagaacacccucuaccuccagaugaacucccuccgcaccgaggacaccgccgucuacuacugcgccaaggaccucggcggcaccaaggacgacgagugggccaccgacuacuacgacugguccaccgccuaccccguccaggacccccgcgccgucgccggcggcuucgaccucuggggccucggcaccauggucaccgucuccucc

SEQ ID NO: 17156 - RNA, 432 nt, Artificial Sequence
  derived and/or modified sequence opt2 from anti-HIV_cap256-119-090815_VR-Chain
cagguccagcucgucgaguccggcggcggcgucgucgagcccggccgcucccuccgccucuccugcgccgccucccaguucuccuucuccuccuacggcaugcacuggguccgccaggcccccggcaagggccucgagugggucgccgccaucuccuucgacggcgccgacaaguaccacgccgacaacgucuggggccgccucuccaucucccgcgacaacuccaaguccacccucuaccuccagaugaacucccuccgccccgaggacaccgccgucuacuucugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccgcc

SEQ ID NO: 17157 - RNA, 438 nt, Artificial Sequence
  derived and/or modified sequence opt2 from anti-HIV_cap256-119-090368_VR-Chain
cagguccagcucgucgaguccggcggcggcgucguccagcccggccgcucccuccgccucuccugcgccgccuccggcuucgccuucucccacuacggcaucuucuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17158 - RNA, 432 nt, Artificial Sequence
  derived and/or modified sequence opt2 from anti-HIV_cap256-119-089710_VR-Chain
cagguccagcucgucgaguccggcggcggcgucguccagcccggccgcucccuccgccucuccugcaccgccuccggcuucggcuucuccaacuacgccaugcacuggguccgccucgcccccggcaagggccucgagugggucgccuccaucuccuacgacggccgcgacuaccaccacgccggcgccgucuggggccgcuucaucaucucccgcgacaacuccaagaacucccuccaccuccagaugaacucccuccgccccgaggacaccgcccucuacuucugcgcccgcgaccuccgcgaguccgagugcgaggagugggaguccgacuacuacaacuucuggaagaagcuccccugcgucaagccccgcggcgucgucggcauccucgacaucuggggccagggcaccgucgucaccgucuccucc

SEQ ID NO: 17159 - RNA, 432 nt, Artificial Sequence
  derived and/or modified sequence opt2 from anti-HIV_cap256-119-088555_VR-Chain
cagguccagcucgucgaguccggcggcggcgucguccaggccggccgcucccuccgccucuccugcgccgccucccaguucaccuucucccgcuacggcaugcacuggguccgccaggcccccggcaagggccucgagugggucgccggcaucuccuacgacggccgcgacaaguaccacgcccacuucgucuggggccgcuucaucaucucccgcgacaacuccaagaacacccucuaccuccagaugaacucccuccgcgccgaggacaccgcccucuacuacugcguccgcgaccuccgcgaguccgagugcgagcucugggaguccgacuacuacgacuucggcaagcgccuccccugcgucaagccccgcggcgucgccggcaccuucgaccucuggggccagggcaccauggucaccgucuccucc

SEQ ID NO: 17160 - RNA, 432 nt, Artificial Sequence
  derived and/or modified sequence opt2 from anti-HIV_cap256-119-087962_VR-Chain
gagaugcagcucgucgaguccggcggcggccucgucaagcccggccgcucccuccgccucuccugcgccgccuccggcuucaccuucuccuccuacgccauccacuggguccgccaggcccccggcaagggccucgagugggucgccgucaucuccuacgacggcuccaacaaguacuacgccgacuccgucaagggccgcuucaccaucucccgcgacaacuccaagaacaccgucuaccuccagaugaacucccuccgcgucgaggacaccgcccucuacuacugcgccaaggaccuccgcgaguacgagugcgaggaguggaccuccgacuacuacgacuucggcaagccccagcccugcaucgacucccgcggcgucgucggcauccucgacaucuggggccagggcaucauggucaccgucuccucc

SEQ ID NO: 17161 - RNA, 432 nt, Artificial Sequence
  derived and/or modified sequence opt2 from anti-HIV_cap256-119-086903_VR-Chain
cagguccaccucgucgaguccggcggcggcgucguccagcccggcaagucccuccgccucuccugcgccgccucccaguucaccuucgaccgcuacggcaugcacuggguccgccaggcccccggcaagggccucgagugggucgccuccaucuccaacgacggcaccgacaaguaccacgccgacaacgucuggggccgcuucaccaucucccgcgacaacuccaagaacacccucuaccucgagaugaacucccuccgcggcgaggacaccgcccucuacuacugcgccaaggacaugcgcgaggacgagugcgaggaguggugguccgacuacuacgacuucggccgcccccagcccugcaucgacucccgcggcgucgucggcaccuuccacgucuggggccagggcaccauggucaccgucuccucc

SEQ ID NO: 17162 - RNA, 432 nt, Artificial Sequence
  derived and/or modified sequence opt2 from anti-HIV_cap256-119-086804_VR-Chain
gagguccagcucgucgaguccggcggcggcgucguccagcccggccgcucccuccgccucuucugcgccggcuccggcuucaccuucuccuccuacggccuccacuggguccgccaggcccccggcaagggccucgagugggucuccuucaucuccuacgacggcuccaccaccaaguacgccgacucccucaagggccgcuucaccgucucccgcgacaacuccaagaacaccgucuaccucgagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17163 - RNA, 432 nt, Artificial Sequence
  derived and/or modified sequence opt2 from anti-HIV_cap256-119-085910_VR-Chain
gagguccagcuccucgaguccggcggcggccucguccagcccggcggcucccuccgccucuccugcgccgccuccggcuucaccuucuccuccuacggcaugcacuggguccgccaggccgccggcaagggccucgagugggucgccuccaucuccuacgacggccgcgacuaccaccacgccggcgccgucuggggccgcuucaucaucucccgcgacaacuccaagaacucccuccaccuccagaugaacucccuccgccccgaggacaccgcccucuacuucugcgcccgcgaccuccgcgaguccgagugcgaggagugggaguccgacuacuacaacuucuggaagaagcuccccugcgucaagccccgcggcgucgucggcauccucgacaucuggggccagggcaccgucgucaccgucuccucc

SEQ ID NO: 17164 - RNA, 432 nt, Artificial Sequence
  derived and/or modified sequence opt2 from anti-HIV_cap256-119-085772_VR-Chain
gagguccgccucgucgaguccggcggcggccucauccagcccggcggcucccuccgccucuccugcgccgccuccggccucaccgucuccuccaaccacauguccuggguccgccaggcccccggcaagggccucgagugggucgccgucaucuccuacgacggcuccaacaccuucuacggcgacuccgucaagggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17165 - RNA, 432 nt, Artificial Sequence
  derived and/or modified sequence opt2 from anti-HIV_cap256-119-084603_VR-Chain
cagguccagcucgucgaguccggcggcggcgucguccaguccggccgcucccuccgccucuccugcgccgccuccggcuuccccuucuccgacuucgccaugcacuggguccgccaggcccccggcaagggccucgagugggucgccuccaucuccuucgucggcaucaagacccacuacgccaacuccguccgcggccgcuucaccaucucccgcgaccaguccaagaacacccucuaccuccagaugaacuccguccgcgucgaggacaccggccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17166 - RNA, 432 nt, Artificial Sequence
  derived and/or modified sequence opt2 from anti-HIV_cap256-119-084276_VR-Chain
cagguccagcucgucgaguccggcggcggcgucguccagcccggccgcucccuccgccucuccugcgccgccucccgcuucaccuucuccuccuacgccaugcacuggguccgccaggcccccggcaagggccucgagugggucgccgucaucugguacgacggcuccaacaaguacuacgccgacuccguccgcggccgcuucuccgucuccaccgacaucuccaagaacacccucuaccuccagaugaacucccuccgccccgccgacaccgcccucuacuucugcgcccgcgaccuccgcuacuacgagugcgaggagugggccuccgacuacuacgacuucggcaaggagcagcccugccucgacccccgcggcgucgucggcaucuucgaccucuggggccagggcaccauggucaccgucuccucc

SEQ ID NO: 17167 - RNA, 432 nt, Artificial Sequence
  derived and/or modified sequence opt2 from anti-HIV_cap256-119-082288_VR-Chain
caggucuaccucgucgaguccggcggcggcgucguccagcccggccgcucccuccgccucuccuccgccgccucccacuucucccucuccuccuacggcaugcacuggguccgccaggcccccggcaagggccucgagugggucgccggcaucuccuucgccggcaccaagaccuacuacggcgacuccgucaagggccgcuucaccgucuccaccgacaucuccaagaacacccucuaccuccaggucaacucccuccgccccgaggacaccgccauguacuacugcgcccgcgaccagcgcuacuacgagugcgaggagugggccuccgacuacuacgacuucggcaaggagcagcccugccucgacccccgcggcgucgucggcaucuucgacaucuggggccagggcaccauggucaccgucuccucc

SEQ ID NO: 17168 - RNA, 432 nt, Artificial Sequence
  derived and/or modified sequence opt2 from anti-HIV_cap256-119-080383_VR-Chain
cagguccagcucgucgaguccggcggcggcgucguccagcccggccgcucccuccgcaucuccugcgccgccucccaguucaccuucucccgcuacggcaugcacuggguccgccaggcccccggcaagggccucgagugggucgccuccaucuccuacgacggcaccgacaaguaccacgcccgccucgucuggggccgcuucaccaucucccgcgacaacuccaagaacacccucuaccuccagaugaacucccuccgcgccgaggacaccgcccucuacuacugcguccgcgacgagcgcgaguccgagugcgagcucugggaguccgacuacuacgacuucggcaagaagcuccccugcgucaagccccgcggcgucaccggcucccucgacauguggggccagggcacccaggucaccgucuccucc

SEQ ID NO: 17169 - RNA, 438 nt, Artificial Sequence
  derived and/or modified sequence opt2 from anti-HIV_cap256-119-079333_VR-Chain
gagguccagcucgucgaguccggcggccgccucguccagcccggcuccccccuccgccucuccugcgccgccucccaguucaacuucgccuccuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17170 - RNA, 441 nt, Artificial Sequence
  derived and/or modified sequence opt2 from anti-HIV_cap256-119-078618_VR-Chain
cagaugcagcucgucgaguccggcggcggcgucguccagcccggccgcucccucacccucuccugcgccgccucccaguucaacuucgccuccuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccacccucuacuucugcgucaaggaccagcgcgaggacgagugcgaggaguggugguccgacuacuacgacuucggccgcgagcuccccugccgcaagucccgcggccucggccucgccggcaacuucugcaucugcggcgccgacggcaccauggucaccgucuccucc

SEQ ID NO: 17171 - RNA, 432 nt, Artificial Sequence
  derived and/or modified sequence opt2 from anti-HIV_cap256-119-077466_VR-Chain
cagguccagcucgucgaguccggcggcggcgucguccagcccggcuccccccuccgcaucuccugcgccgucucccaguucaccuucucccgcuacggcaugcacuggguccgccaggcccccggcaagggccucgagugggucgccuccaucuccuucgacggccgcgacaaguaccacuccucccucgucuggggccgccucaccaucucccgcgacaacuccaaguccacccucuuccuccagaugaacucccuccgcgccgaggacaccgcccucuacuacugcgcccgcgaccuccgcgaguccgagugcgaggagugggaguccgacuacuacgccuucuaccgcaagcuccccugcgucaagccccgcggcgucgccggcacccucgacaucuggggccagggcaccauggucaccgucuccucc

SEQ ID NO: 17172 - RNA, 423 nt, Artificial Sequence
  derived and/or modified sequence opt2 from anti-HIV_cap256-119-076284_VR-Chain
cagguccagcucgucgaguccggcggcggcgucguccagcccggccgcucccuccgccucuccugcgccgccuccaacaccuacgccaugcacuggguccgccaggcccccggcaagggccucgaguggauggcccucaucuccuacgagggcuccgacaaguacuacgucgacuccgucaagggccgcuucaccaucucccgcgacaacuccaaguccacccucuaccuccagaugaacucccucuccgccgaggacaccgccgucuacuucugcgccaaggaccucggcggcaacaaggacgacgaguggaccaccgacuacuacuacgacugguccaaggcccgccccguccaggacccccgcgucgucgccggcaccuucgacaucuggggccagggcaccauggucaccgucuccucc

SEQ ID NO: 17173 - RNA, 432 nt, Artificial Sequence
  derived and/or modified sequence opt2 from anti-HIV_cap256-119-074680_VR-Chain
gagguccagcucgucgaguccggcggcggccucguccagcccggccgcucccuccgccucuccugcgccggcuccggcuucaccuucgucgacuacgccaugcacuggguccgccagguccccggcaagggccucgagugggucggcuccaucuccuacgacggcuccgacaaguaccacaccaacuccgucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17174 - RNA, 432 nt, Artificial Sequence
  derived and/or modified sequence opt2 from anti-HIV_cap256-119-074081_VR-Chain
gagguccagcucgucgaguccggcggcggccucguccagcccggcggcucccuccgccucuccugcgucgucuccggcgucaccgucuccuccaacuacauguccuggguccgccaggcccccggcaagggccucgagugggucgccuccaucuccuacgacggcuccgacaaguaccacgccgaccgcgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17175 - RNA, 432 nt, Artificial Sequence
  derived and/or modified sequence opt2 from anti-HIV_cap256-119-071704_VR-Chain
cagaugcagcucgucgaguccggcggcggcgucguccagcccggcggcucccuccgccucuccugcgccgucucccaguucaccuucaccuccuacggcaugcacuggguccgccaggcccccggcaagggccucgagugggucgccaccaucuccuccgacggcuccaagaaguaccacggcgacuccgucuggggccgccucaccaucucccgcgacaacuccaagaacacccucuuccuccagaugaacaaccuccgcgccgaggacaccgcccucuacuucugcgucaaggaccagcgcgaggacgagugcgaggaguggugguccgacuacuacgacuucggcaagaagcuccccugccgcaagucccccggccucgccggcaucuucgacgucuggggccacggcaccauggucaccgucuccccc

SEQ ID NO: 17176 - RNA, 432 nt, Artificial Sequence
  derived and/or modified sequence opt2 from anti-HIV_cap256-119-071266_VR-Chain
cagguccagcucgucgaguccggcggcggcgucguccagcccggcgagucccuccgccucuccugcgccgccuccggcuucaccuucuccuccuucggcaugcacuggguccgccaggcccccggcaagggccucgagugggucggcuccaucuccuacgacggcuccgacaaguaccacaccaacuccgucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17177 - RNA, 432 nt, Artificial Sequence
  derived and/or modified sequence opt2 from anti-HIV_cap256-119-069667_VR-Chain
gagguccagcucgucgaguccggcggcggccucguccagcccggccgcucccuccgccucuccugcgccgccuccggcuucuccuucaacaccuacggcaugcacuggguccgccaggcccccggcaagggccucgagugggucgccuucauccgcuacgacggcuccaacaaguacuacgccgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17178 - RNA, 432 nt, Artificial Sequence
  derived and/or modified sequence opt2 from anti-HIV_cap256-119-069591_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccggcaucuccuacgacggcuccgacaaguaccacgccgacaaggucuggggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggcaagcgccuccccugccgcaagucccgcggcgucgccggcgucuucgacaaguggggccagggcaccauggucaccgucuccucc

SEQ ID NO: 17179 - RNA, 432 nt, Artificial Sequence
  derived and/or modified sequence opt2 from anti-HIV_cap256-119-068691_VR-Chain
cagggccaccucgucgccuccggcggcggcgucgucccccccggccgcucccucacccucuccugccucgccucccaguucaccuucuccggcuacggcuuccacuggguccgccaggcccccggcaagggccucgagugggucgccuccaucuccuucgccggcaccaagaagcacuacggcaacuccgucaagggccgcuucaccaucucccgcgacaacuccaagaacacccucuaccucgagaugaacucccuccgccccgaggacaccgcccucuacuacugcgccaaggaccgccgcgaguacgagugcgaggaguggaccuccgacuacuacgacuucggccgcccccagcccugcaucgacucccgcggcgucgucggcauccucgacaucuggggccgcggcaccauggucaccgucuccucc

SEQ ID NO: 17180 - RNA, 432 nt, Artificial Sequence
  derived and/or modified sequence opt2 from anti-HIV_cap256-119-068488_VR-Chain
cagaugcagcucgucgaguccggcggcggcgucguccagcccggcaugucccucacccucuccugcgccgccucccaguucaccuucuccaacuacggcaugcacuggguccgccaggcccccggcaagggccucgagugggucgccuccaucuccaacgacggcuccaagaaguaccacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17181 - RNA, 432 nt, Artificial Sequence
  derived and/or modified sequence opt2 from anti-HIV_cap256-119-067536_VR-Chain
cagguccagcucgucgaguccggcggcggcgucguccagcccggccgcucccuccgcaucuccugcgccuccucccaguucaccuucucccgcuacggcaugcacuggguccgccaggcccccggcaagggccucgagugggucgccuccaucuccuacgacggccgcgacuaccaccacgccggcgccgucuggggccgcuucaucaucucccgcgacaacuccaagaacucccuccaccuccagaugaacucccuccgccccgaggacaccgcccucuacuucugcgcccgcgaccuccgcgaguccgagugcgaggagugggaguccgacuacuacgccuucuaccgcaagcuccccugcgucaagccccgcggcgucgccggcacccucgacaucuggggccagggcaccauggucaccgucuccucc

SEQ ID NO: 17182 - RNA, 432 nt, Artificial Sequence
  derived and/or modified sequence opt2 from anti-HIV_cap256-119-065852_VR-Chain
cagguccaccucgucgaguccggcggcggcgccguccccuccggccgcucccuccgccucuccugcgucgccuccggcuucaccuucggcgucuacgacauccacuggguccgccaggcccccggcaagggccucgagugggucgccuccaucuccuacgacggccgcgacaaguaccacuccucccucgucuggggccgccucaccaucucccgcgacaacuccaaguccacccucuuccuccagaugaacucccuccgcgccgaggacaccgcccucuacuacugcgcccgcgaccuccgcgaguccgagugcgaggaguggcaguccgacuacuacgccuucuacaagaagcuccccugcgucaagccccgcggcgucgccggcacccucgacaucuggggccagggcaccauggucaccgucuccucc

SEQ ID NO: 17183 - RNA, 432 nt, Artificial Sequence
  derived and/or modified sequence opt2 from anti-HIV_cap256-119-065457_VR-Chain
cucggccgccucgucgccuccggcggcggcgucgucccccccggccgcuccccccgccucuccugcgucgccucccaguucaccuucuccggcugcggccuccacuggguccgccaggcccccggcaagggccucgagugggucgccgccaucuccuucgacggcaccgacaaguaccacuccgacgacgucuggggccgcuucaccaucucccgcgacaacuccaagaacacccucuaccuccagaugaacucccuccgccccgaggacaccgcccucuacuacugcgccaaggaccuccaggaggacgagugcgaggaguggugguccgacuacuacgacuucggcaagcagcuccccugccgcaagucccgcggcgucgccggcaucuucgacgacuggggccagggcaccauggucaccgucuccucc

SEQ ID NO: 17184 - RNA, 432 nt, Artificial Sequence
  derived and/or modified sequence opt2 from anti-HIV_cap256-119-064501_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccggcaucuccuacgacggccgcgacaaguaccacgcccacuccgucuggggccgccucuccaucucccgcgacaacuccaagaacacccucuaccuccagaugaacucccuccgcaccgaggacaccgcccucuaccacugcguccgcgaccuccgcgaguccgagugcgagcucugggaguccgacuacuacgacuucggcaagaagcuccccugcgucaagccccgcggcgucgccggcaccuucgaccucuggggccagggcaccauggucaccgucuccucc

SEQ ID NO: 17185 - RNA, 432 nt, Artificial Sequence
  derived and/or modified sequence opt2 from anti-HIV_cap256-119-063568_VR-Chain
cagguccagcccgucgaguccggcggcggcgucgucuggcccggccgcucccuccgccucuccugcaccaccuccggcuucaccuucuccaacuacgccauccacuggguccgccaggcccccggcaagggccuccagugggucgccgucaucuccuacgacggcuccaacaaguucuacgccgacuccgucaagggccgcuucaccaucucccgcgacaacuccaagaacacccucuaccuccagaugaacucccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17186 - RNA, 435 nt, Artificial Sequence
  derived and/or modified sequence opt2 from anti-HIV_cap256-119-063103_VR-Chain
cagguccagcucgucgaguccggcggcggccucguccagcccggcaagucccuccgccucuccugcgccgccuccggcuucaccuucuccaccuacggcaugcacuggguccgccaggcccccggcaagggccucgagugggucgcccucaucuccuacgacggcuccuacaccuacuacgccgacuccgucaagggccgcuucaccaucucccgcgacaacuccaaguccacccucgaccuccagcucaacacccuccgccccgaggacaccgcccucuacuacugcgcccgcgaccuccgcgagauggagugcgaggaguggaagcucuacaacuacuacgacuuccgcacccgcggccccugcgucgacccccgcggcgucgucggcuccuucgacgucuggggccagggcaccgucgucaccgucuccucc

SEQ ID NO: 17187 - RNA, 432 nt, Artificial Sequence
  derived and/or modified sequence opt2 from anti-HIV_cap256-119-061027_VR-Chain
cagguccagcucgucgaguccggcggcggcgucguccagcccggccgcucccuccgccucuccugcuccgccuccggcuucacccucuccuccuacggcauccacuggguccgccaggcccccggcaagggccucgagugggucgccgucauguccaacgacggcuccaaccaguucuacggcgacuccgucaagggccgcuucaccaucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17188 - RNA, 432 nt, Artificial Sequence
  derived and/or modified sequence opt2 from anti-HIV_cap256-119-058232_VR-Chain
cagguccagcucgucgaguccggcggcggcgucguccagcccggcaagucccuccgccucuccugcaaggccucccaguucaccuucaaccgcuacggcaugcacuggguccgccaggcccccggcaagggccucgagugggucgccgccaucuccuucgacggcaccgacaaguaccacgccgacaaggucuggggccgcuucaccaucucccgcgacgacuccaaguccacccucuaccuccagaugaacucccuccgcgccgaggacaccgcccucuacuacugcgccaaggaccuccgcgaggacgagugcgaggaguggugguccgacuacuacgacuucggcaagcagcuccccugccgcaagucccgcggcgucgccggcaucuucgacggcuggggccagggcaccauggucaccgucuccucc

SEQ ID NO: 17189 - RNA, 432 nt, Artificial Sequence
  derived and/or modified sequence opt2 from anti-HIV_cap256-119-057341_VR-Chain
cagguccagcucgucgaguccggcggcggcgucguccagcccggccgcucccuccgccucuccugcgccgccucccacuucucccucuccuccuacggcaugcacuggguccgccaggcccccggcaagggccucgagugggucgccggcgaguccuucgccgccaccaacaaguacuacgccgacuccgucaagggccgcuucaucgucucccgcgacaucuccaagaacacccucuaccucgaggucaacucccuccgcgccgaggacaccgcccucuacuacugcgcccgcgaccagcgcuacuacgagugcgaggagugggccuccgacuacuacgacuucggccgcgagcagcccugccaggacccccgcggcgucgccggcaucuucgacaucuggggccagggcaccauggucaccgucuccucc

SEQ ID NO: 17190 - RNA, 438 nt, Artificial Sequence
  derived and/or modified sequence opt2 from anti-HIV_cap256-119-056895_VR-Chain
cagaugcagcucgucgaguccggcggcggcgucguccagcccggccgcucccuccgccucuccugcgccgccucccaguucaccuucggcuccuacggcaugcacuggguccgccagauccccggcaagggccucgagugggucgccaccaucuccuacgacggcaccaagaaguaccacgccgacuccgucugggaccgcuucaucaucucccgcgacaacuccaagaacacccucuuccuccagaugaacucccuccgccccgaggacaccgcccucuacuucugcgucaaggaccagcgccaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17191 - RNA, 432 nt, Artificial Sequence
  derived and/or modified sequence opt2 from anti-HIV_cap256-119-056402_VR-Chain
caggucaagcucgucgaguccggcggcggcgucguccagcccggcaagucccuccgccucuccugcaccgccucccaguucaccuucuccaacuucggcaugcacuggguccgccaggcccccggcaagggccucgagugggucgccuccaucuccuucgucggcaucaagaagcacuacgccaacuccguccgcggccgcuucaccaucucccgcgaccaguccaagaacacccucuaccuccagaugaacuccguccgcgucgaggacaccgcccgcuacuucugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17192 - RNA, 432 nt, Artificial Sequence
  derived and/or modified sequence opt2 from anti-HIV_cap256-119-056034_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgccaucuccuucgccggcaccaagacccacuacgccgacuccgucaagggccgcuucaccaucucccgcgacaacuccaagaacgcccucuaccuccagaugaacaaccuccgcgccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17193 - RNA, 432 nt, Artificial Sequence
  derived and/or modified sequence opt2 from anti-HIV_cap256-119-055042_VR-Chain
cagguccagcucgucgaguccggcggcggcgucgcccagcccggccgcucccuccgccucuccugcgccgccuccggcuucaccuuccgcuccuacggcaugcacuggguccgccaggcccccggcaagggccucgagugggucgccgucaucucccucgacggcuccaacaaguacuacgccgacuccgucaagggccgcuucuccaucucccgcgacaacuccaagaacacccucuaccuccagaugaacucccuccgccccgaggacaccgccgucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17194 - RNA, 438 nt, Artificial Sequence
  derived and/or modified sequence opt2 from anti-HIV_cap256-119-054776_VR-Chain
cagguccagcucauggaguccggcggcggcgucguccagcccggccgcucccuccgccucuccugcaccgccuccggcuucaccuucuccuccuacuccaugcacuggguccgccaggcccccggcaagggccucgagugggucgccaucaucuccuacgacgaguccaacaaguacuacgccgacuccguccagggccgcuucaccaucucccgcgacaacuccaagaacacccucuuccuccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17195 - RNA, 432 nt, Artificial Sequence
  derived and/or modified sequence opt2 from anti-HIV_cap256-119-054539_VR-Chain
cagaugcagcucgucgaguccggcggcggcgucguccagcccggcggcucccuccgccucuccugcgccgccucccaguucaccuucggcuccuacgccaugcacuggguccgccagccccccggcgagcgccccgagugggucgccaccaucuccuucgacggcaccaagaaguaccacgccgacuccgucuggggccgcuucaccaucucccgcgacaacuccaagaacacccucuuccuccagaugaacucccuccgccccgaggacaccgcccucuacuucugcgucaaggaccagcgcgaggacgccugcgaggaguggugguccgacuacuacgacuucggcaagaacugccucgccgagucccccggcgccuggcucgaguucuucuacgucuggggccacggcaccauggucaccgucuccucc

SEQ ID NO: 17196 - RNA, 432 nt, Artificial Sequence
  derived and/or modified sequence opt2 from anti-HIV_cap256-119-054112_VR-Chain
cagguccagcucgucgaguccggcggcggcgucguccaggccggccgcucccuccgccucuccugcgccgccuccggcuucaccuucuccaccuacgccaugcacuggguccgccaggcccccggcaagggccucgagugggucgccgucaucuccuacgacggcuccaacaaguacuacgccgacuccguccgcggccgcuucaccaucucccgcgacaacuccaagaacacccucuaccuccagaugaacucccuccgcgccgaggacaccgcccucuacuacugcgccaaggacaugcgcgaguacgagugcgaggaguggaccuccgacuacuacgacuucggccgcccccagcccugcaucgacucccgcggcgucgucggcaccuuccacgucuggggccagggcaccauggucaccgucuccucc

SEQ ID NO: 17197 - RNA, 432 nt, Artificial Sequence
  derived and/or modified sequence opt2 from anti-HIV_cap256-119-053339_VR-Chain
cagguccaccucgucgaguccggcggcggcgucguccagcccggccgcucccuccgccucuccugcgccgccucccacuucucccucuccuccuacggcaugcacuggguccgccaggcccccggcaagggccucgagugggucaccggcaucuccuucgccggcaccaagaccuacuacggcgacuccguccgcggccgcuucaccgucucccgcgacaucuccaagaacacccuccuccuccagaugaacucccuccgccccgacgacaccgccaucuacuacugcgcccgcgaccagcgcuacuacgagugcgaggagugggccuccgacuacuacgacuucggcaaggagcagcccugccucgacccccgcggcgucgucggcaucuucgaccucuggggccagggcaccauggucaccgucuccucc

SEQ ID NO: 17198 - RNA, 432 nt, Artificial Sequence
  derived and/or modified sequence opt2 from anti-HIV_cap256-119-052404_VR-Chain
cagaugcagcucgucgaguccggcggcggcgucguccagcccggccgcucccucacccucuccugcaucgccucccaguucaacuucgccuccuacggcaugcacuggguccgccaggcccccggcaagggccucgagugggucgccuccaucucccacgacggcaccaagaaguaccacgccgaguccgucuggggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggcaagcagcuccccugccgcaagucccgcggcgucgccggcgucuucgacaacuggggccagggcaccauggucaccgucuccucc

SEQ ID NO: 17199 - RNA, 432 nt, Artificial Sequence
  derived and/or modified sequence opt2 from anti-HIV_cap256-119-051123_VR-Chain
cagguccagcucgucgaguccggcggcggcgucguccagcccggcggcucccuccgccucuccugcgucggcucccaguucauccucuaccgcuacggcaugcacuggguccgccaggcccccggcaagggccucgagugggucgccgccgucuccuucgacggcaccgacaaguaccacgccgacgacgucuggggccgcuucaccaucucccgcgacaacuccaagaacauccucuaccuccagaugaacucccuccgcgccgaggacaccgcccucuacuacugcgccaaggaccuccgcgaggacgagugcgaggaguggugguccgacuacuacgaccucggcaagcagcuccccugccgcaagucccgcggcgucgccggcgucuucgacaaguggggccucggcaccauggucaccgucuccucc

SEQ ID NO: 17200 - RNA, 438 nt, Artificial Sequence
  derived and/or modified sequence opt2 from anti-HIV_cap256-119-051077_VR-Chain
gagguccagcucgucgaguccggcggcggcgucguccaguccggccgcucccuccgccucuccugcgccgccucccacuucaccuucucccgcuacggcaugcacuggguccgccaggcccccggcaagggccucgagugggucgccuccaucuccuacgacggccgcgacuucuaccacgcccgcuccgucuggggccgcuucaccaucucccgcgacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17201 - RNA, 432 nt, Artificial Sequence
  derived and/or modified sequence opt2 from anti-HIV_cap256-119-050442_VR-Chain
caggcccagauggucgaguccggcggcggcgucguccagcccggccgcucccuccgccucuccugcgccgccuccggcuucuccuucuccuacuucgccaugcacuggguccgccaggcccccggcaagggccucgagugggucgccggcaucuccuucgccgccaccaagaccuacuacggcggcuccgucaagggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17202 - RNA, 432 nt, Artificial Sequence
  derived and/or modified sequence opt2 from anti-HIV_cap256-119-049433_VR-Chain
cagguccagcucgucgaguccggcggcggcgucguccagcccggccgcucccuccgcgucuccugccgcgccuccggcuucgccuucuccuccuacgccaugcacuggguccgccaggcccccgucaagggccucgagugggucgcccucaccuccuccgacggcgccgacaaguaccacgccgacgacgucuggggccgcuucaccaucucccgcgacaacuccaagaacacccucuaccuccagaugaacucccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17203 - RNA, 432 nt, Artificial Sequence
  derived and/or modified sequence opt2 from anti-HIV_cap256-119-047532_VR-Chain
cucggccgccucgucgccuccggcggcggcgucgucccccccggccgcucccucacccucuccugcgucgccucccaguucaccuucuccggcugcggccuccacuggguccgccaggcccccggcaagggccucgagugggucgccuccaucuccuucgccggcaccaagaagcacuacaccaacuccguccgcggccgcuucaccaucucccgcgacaacuccaagaacaccgucuaccuccagaugaacucccuccgcgccgaggacaccgcccucuacuacugcgccaaggacaugggcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17204 - RNA, 432 nt, Artificial Sequence
  derived and/or modified sequence opt2 from anti-HIV_cap256-119-047489_VR-Chain
cagguccaccucgucgaguccggcggcggcgucguccagcccggcaagucccuccgccucuccugcgccgccucccaguucaccuucaaccgcuucggcaugcacuggguccgccaggcccccggcaagggccucgagugggucgccggcaucuccuacgacggcuccgacaaguaccacgccgacaaggucuggggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggcaagcgccuccccugccgcaagucccgcggcgucgccggcgucuucgacaaguggggccagggcaccauggucaccgucuccucc

SEQ ID NO: 17205 - RNA, 438 nt, Artificial Sequence
  derived and/or modified sequence opt2 from anti-HIV_cap256-119-046020_VR-Chain
gagguccagcuccuccaguccggcggcggccucguccagcccggcggcucccuccgccucuccugcgccgccuccggcuucuccuucuccuccuacgccauguccuggauccgccaggcccccggcaagggccucgagugggucgccuccaucucccacgacggcaccaagaaguaccacgccgaguccgucuggggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17206 - RNA, 432 nt, Artificial Sequence
  derived and/or modified sequence opt2 from anti-HIV_cap256-119-044746_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacaccgucuaccucgagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17207 - RNA, 432 nt, Artificial Sequence
  derived and/or modified sequence opt2 from anti-HIV_cap256-119-044740_VR-Chain
cagaugcaccucgucgaguccggcggcggcgucguccagcccggcaugucccuccgccucuccugcgccgccucccaguucaacuucggcuccuucggcaugcacuggguccgccaggcccccggcaagggccucgagugggucgccaccaucuccuacgacggcaccaagaaguaccacuccgacuccgucuggggccgccucuccaucucccgcgacaacuccaagaacacccucuuccuccagaugaacucccuccgcaccgaggacaccgcccucuacuucugcguccgcgaccagcgcgaggacgacugcgaggaguggugguccgacuacuacgacuucggcaagaagcuccccugccgcaagucccgcggccucgccggcaucuucgacaucuggggccacggcaccauggucaccgucuccucc

SEQ ID NO: 17208 - RNA, 432 nt, Artificial Sequence
  derived and/or modified sequence opt2 from anti-HIV_cap256-119-043790_VR-Chain
cuccuccagcucgucgaguccggcggcggcgucguccagcccggcaacucccuccgccucuccugcgccgccgccggcuucaccuucuccgacuacucccuccacuggguccgccaggcccccggcaagggccucgagugggucgccaugaucuccgacgacggcaaccucgacuucuacgccgccuccgucaagggccgcuucaccaucucccgcgacaacuccaucaacaccgucuaccuccagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17209 - RNA, 432 nt, Artificial Sequence
  derived and/or modified sequence opt2 from anti-HIV_cap256-119-042880_VR-Chain
gagguccgccucgucgaguccggcggcggccucguccagcccggcggcucccuccgccucuccugcgccgccuccggcuucacccucuccgacuacuacauguccuggauccgccaggcccccggcaagggccucgagugggucgccgccaucuccuucgccggcaccaagaagcacuacggcaacuccgucaagggccgcuucaccaucucccgcgacaacuccaagaacacccucuaccucgagaugaacucccuccgcgucgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17210 - RNA, 432 nt, Artificial Sequence
  derived and/or modified sequence opt2 from anti-HIV_cap256-119-042606_VR-Chain
cagaugcagcucgucgaguccggcggcggcgucguccagcccggccgcucccuccgccucuccugcgccgccucccaguucaccuucggcuccuacggcaugcacuggguccgccagauccccggcaagggccucgagugggucaccggcaucuccuucgccgccaccaagaccuacuacggcgacuccguccgcggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcauccucgaccucuggggccagggcaccauggucaccgucuccucc

SEQ ID NO: 17211 - RNA, 432 nt, Artificial Sequence
  derived and/or modified sequence opt2 from anti-HIV_cap256-119-042444_VR-Chain
cagguccagcucgucgaguccggcggcgacgucguccaccccggcggcucccuccgccucuccugcgccgccuccggcuucaccuucuccuccuacggcauccacuggguccgccaggcccccggcaagggccucgagugggucgccgccaucuccuacgacggcuccgacaaguaccacaccaacuccgucuggggccgcuucaccgucucccgcgacaacuccaagaacaccgucuaccuccagaugaacucccuccgcgccgaggacaccgcccucuacuucugcguccgcgaccgccgcgaguccgagugcgagcucugggaguccgacuacuacgacuucggcaagcgccuccccugcgucaagccccgcggcgucgccggcgucuucgacaucuggggccagggcaccauggucaccgucuccucc

SEQ ID NO: 17212 - RNA, 432 nt, Artificial Sequence
  derived and/or modified sequence opt2 from anti-HIV_cap256-119-040328_VR-Chain
cagguccagcucgucgaguccggcggcggcgucguccagcccggcggcucccuccgccucuccugcgccgccuccggcuucaccuucuccuccuacuccaugaacuggguccgccaggcccccggcaagggccucgagugggucgccuccaucuccuucgccggcaccaagcagcacuacggcaacuccgucaagggccgcuucaccaucucccgcgacaacuccaagaacaccgucuaccuccagaugaacucccuccgccucgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17213 - RNA, 432 nt, Artificial Sequence
  derived and/or modified sequence opt2 from anti-HIV_cap256-119-040164_VR-Chain
cagaugcaccucgucgaguccggcggcggcgucguccagcccggcaugucccuccgccucuccugcgccgccucccaguucaacuucggcuccuucggcaugcacuggguccgccaggcccccggcaagggccucgagugggucgccaccaucuccuacgacggcaccaagaaguaccacuccgacuccgucuggggccgcuucuccaucucccgcgacaacuccaagaacacccucuaccuccagaugaacucccuccgcaccgaggacaccgcccucuacuucugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17214 - RNA, 432 nt, Artificial Sequence
  derived and/or modified sequence opt2 from anti-HIV_cap256-119-039130_VR-Chain
gaggagcagcucgucgaguccggcggcggccucguccagcccggccgcucccuccgccucuccugcaccggcuccggcuuccgcuucggcgacuacgccaugaacuggguccgccaggcccccggcaagggccucgagugggucaccuucaucuccuacgacggcuccaacaagcacuacgccgacuccgucaagggccgcuucaccgucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17215 - RNA, 432 nt, Artificial Sequence
  derived and/or modified sequence opt2 from anti-HIV_cap256-119-038138_VR-Chain
cagguccagcucgucgaguccggcggcggcgucguccagaccggccgcucccuccgccucuccugcaccggcucccaguucaccuucggccgcuacggcauguacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17216 - RNA, 432 nt, Artificial Sequence
  derived and/or modified sequence opt2 from anti-HIV_cap256-119-037868_VR-Chain
cagguccagcucgucgaguccggcggcggcgucguccagcccggccgcucccuccgccucuccugcgccgccucccaguucaccuucuccaaguacggcaugcacuggguccgccaggcccccggcaagggccuccagugggucgccggcaucuccuacgacggcuccgacaaguaccacgcccacuucgucuggggccgcuucuccaucucccgcgacaacuccaagaacgcccucuaccuccagaugaacucccuccgcaccgaggacaccgcccucuacuucugcguccgcgaccuccgcgaguccgagugcgaggaguggaaguccgacuacuacgacuucggccgcaagggccccugccucaagccccgcggcgucgccggcuccuucgacaucuggggccagggcaccgucgucaccgucuccucc

SEQ ID NO: 17217 - RNA, 432 nt, Artificial Sequence
  derived and/or modified sequence opt2 from anti-HIV_cap256-119-037102_VR-Chain
caggucaagcucgucgaguccggcggcggcgucguccagcccggcaagucccuccgccucuccugcaccgccucccaguucaccuucuccaacuucggcaugcacuggguccgccaggcccccggcaagggccucgagugggucgccuccaucuccuucgucggcaucaagaagcacuacgccaacuucguccgcggccgcuucaccaucucccgcgaccaguccaagaacacccucuaccuccagaugaacuccguccgcgucgaggacaccgcccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17218 - RNA, 438 nt, Artificial Sequence
  derived and/or modified sequence opt2 from anti-HIV_cap256-119-036683_VR-Chain
ggcguccagcucgucgaguccggcggcgccgucguccgccccggcggcucccucacccucuccugcgccgccucccaguucauccucuccuccuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17219 - RNA, 432 nt, Artificial Sequence
  derived and/or modified sequence opt2 from anti-HIV_cap256-119-036495_VR-Chain
cagguccagcucgucgaguccggcggcggcgucguccagcccggccgcucccuccgccucuccugcgccgccuccggcuucuccuucuccuccuacggcaugcacuggguccgccaggcccccggcaagggccucgagugggucgccuccaucuccuucgucggcaucaagacccacuacgccaacuccguccgcggccgcuucaccaucucccgcgaccaguccaagaacacccucuaccuccagaugaacuccguccgcaucgaggacaccgcccgcuacuucugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17220 - RNA, 438 nt, Artificial Sequence
  derived and/or modified sequence opt2 from anti-HIV_cap256-119-035375_VR-Chain
gagguccagcucgucgaguccggcggcggccucguccagcccggccgcucccuccgccucuccugcgccgccuccggcuucacccucgaggacuacggcaugcacuggguccgccaggcccccggcaagggccucgagugggucgccuccaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17221 - RNA, 438 nt, Artificial Sequence
  derived and/or modified sequence opt2 from anti-HIV_cap256-119-035165_VR-Chain
cagguccaccucgucgaguccggcggcggcgucggccagcccgcccgcucccuccgccucuccugcgccgccuccggcuucauccucuccuccuacggccuccacuggguccgccaggcccccggcaagggccucgagugggucgcccucaucuccuacgacggcaacaacgaguacuacgccgaguccgucuggggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17222 - RNA, 432 nt, Artificial Sequence
  derived and/or modified sequence opt2 from anti-HIV_cap256-119-035109_VR-Chain
cagguccagcucgucgaguccggcggcggcgucguccagcccggccgcucccuccgccucuccugcgccaccgccggcuucaccuucuccuccuacgccaugcacuggguccgccaggcccccggcaagggccucgagugggucgccuccaucuccuacgacggcuccgacaaguaccacgccgaccucgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17223 - RNA, 339 nt, Artificial Sequence
  derived and/or modified sequence opt2 from anti-HIV_cap256-119-033789_VR-Chain
caggucuaccucgucgaguccggcggcggcgucguccagcccggccgcucccuccgccucuccugcgccgccucccacuucucccucuccuccuacggcaugcacuggguccgccaggcccccgacaucuccaagaacacccucuaccuccaggucaacucccuccgccccgaggacaccgccauguacuacugcgcccgcgaccagcgcuacuacgagugcgaggagugggccuccgacuacuacgacuucggcaaggagcagcccugccucgacccccgcggcgucgucggcaucuucgacaucuggggccagggcaccauggucaccgucuccucc

SEQ ID NO: 17224 - RNA, 432 nt, Artificial Sequence
  derived and/or modified sequence opt2 from anti-HIV_cap256-119-033641_VR-Chain
cagguccagcucgucgaguccggcggcggcgucguccagaccggccgcucccuccgccucuccugcaccggcucccaguucaccuucggccgcuacggcauguacuggguccgccaggcccccggcaagggccucgagugggucgccgccaucuccuacgacggcuccgacaaguaccacaccaacuccgucuggggccgcuucaccgucucccgcgacaacuccaagaacaccgucuaccuccagaugaacucccuccgcgccgaggacaccgcccucuacuucugcguccgcgaccgccgcgaguccgagugcgagcucugggaguccgacuacuacgacuucggcaagcgccuccccugcgucaagccccgcggcgucgccggcgucuucgacaucuggggccagggcaccauggucaccgucuccucc

SEQ ID NO: 17225 - RNA, 432 nt, Artificial Sequence
  derived and/or modified sequence opt2 from anti-HIV_cap256-119-032113_VR-Chain
cagguccagcucgucgaguccggcggcggcgucguccagcccggccgcccccuccgccucuccugcgucggcuccggcuucuccuucaucaccuccgccaugcacuggguccgccaggcccccgacaagggccucgagugggucgccaucaucuccgacggcggcaacaaccgccacuacgccgacuccgucaagggccgcuucaccaucucccgcgacaacuccaagaacaccgucuuccucgaggucaacaaccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17226 - RNA, 432 nt, Artificial Sequence
  derived and/or modified sequence opt2 from anti-HIV_cap256-119-031739_VR-Chain
cagguccagcucgucgaguccggcggcggcgucguccagcccggccgcucccuccgcaucuccugcgccgccucccaguucaccuucaaccgcuacggcaugcacuggguccgccaggcccccggcaagggccucgagugggucgccuccaucuccuacgacggcuccgacaaguaccacgccggccucgucuggggccgcuucaucaucucccgcgacaacuccaagaacacccucuaccuccagaugaacucccuccgcgccgaggacaccgcccucuacuacugcguccgcgacgagcgcgaguccgagugcgagcucugggaguccgacuacuacgacuucggcaagaagcuccccugcgucaagccccgcggcgucgccggcacccucgacaucuggggccagggcacccgcgucaccgucuccucc

SEQ ID NO: 17227 - RNA, 432 nt, Artificial Sequence
  derived and/or modified sequence opt2 from anti-HIV_cap256-119-030932_VR-Chain
gagguccagcuccucgaguccggcggcggcgucguccagcccggccgcucccuccgccucuccugcgccgccuccggcuucgccuucucccacuacggcaucuucuggguccgccaggcccccggcaagggccucgagugggucaccgucaucuccggcgacggcuccacccagugguacgccgacuccguccagggccgcuucaccaucucccgcgacuccuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17228 - RNA, 438 nt, Artificial Sequence
  derived and/or modified sequence opt2 from anti-HIV_cap256-119-030740_VR-Chain
cagguccagcucgucgaguucggcggcggcgucguccagaccggccgcucccuccgccucuccugcgccgccuccggcuucaccuucuccgacuacggcaugcacuggguccgccaggcccccggcaagggccucgagugggucgccuccaucuccaacgacggcuccaagaaguaccacggcgacuccgucugggcccgcuucaucaucucccgcgacaacuccaagaacacccucuuccuccagauguccucccuccgcgccgaggacaccgcccucuacuucugcguccgcgaccaccgcgaggacgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17229 - RNA, 438 nt, Artificial Sequence
  derived and/or modified sequence opt2 from anti-HIV_cap256-119-030197_VR-Chain
cagguccaccucgucgaguccggcggcggcgucguccagcccggcaagucccuccgccucuccugcgccgccucccaguucaccuucugccgcuacggcaugcacuggguccgccaggcccccggcaagggccucgagugggucgccuccaucuccaacgacggcaccgacaaguaccacgccgacaacgucuggggccgcuucaccaucucccgcgacaacuccaagaacacccucuaccucgagaugaacucccuccgcggcgaggacaccgcccucuacuacugcgccaaggacaugcgcgaggacgagugcgaggaguggugguccgacuacuacgacuucggcaaggagcuccccugccgcaaguggaagacccgcggcgucgccggcauccucgacaacuggggccagggcaccauggucaccgucuccucc

SEQ ID NO: 17230 - RNA, 438 nt, Artificial Sequence
  derived and/or modified sequence opt2 from anti-HIV_cap256-119-027047_VR-Chain
cagaugcagcucgucgaguccggcggcggcgucguccagcccggccgcucccucacccucuccugcgccgccucccaguucaccuuccgcaacuacggcaugcacuggguccgccaggcccccggcaagggccucgagugggucgccuccaucuccaaggacggcaccaagaaguaccacggcgacuccgucuggggccgcuucaucaucucccgcgacaacuccaagaacacccucuuccuccagauguccucccuccgcgccgaggacaccgcccucuacuucugcguccgcgaccagcgcgaggccgagugcgaggaguggugguccgacuacuacgacuucggccgcgagcuccccugccgcaaguuccgcggccucggccucgccggcaucuucgacaucuggggccacggcaccauggucaccgucuccucc

SEQ ID NO: 17231 - RNA, 432 nt, Artificial Sequence
  derived and/or modified sequence opt2 from anti-HIV_cap256-119-026950_VR-Chain
cagguccagcucgucgaguccggcggcggcgucguccagcccggcaagucccuccgcaucuccugcgccgccucccgcuucaccuucggccgcuucggcaugcacuggguccgccaggcccccggcaagggccucgagugggucgccuccaucuccuacgacggcuccgacaaguaccacgccggccucgucuggggccgcuucaucaucucccgcgacaacuccaagaacacccucuaccuccagaugaacucccuccgcgccgaggacaccgcccucuacuacugcguccgcgacgagcgcgaguccgagugcgagcucugggaguccgacuacuacaacuucggcaagaacuaccccugcgucaagccccgcggcgucgccggcacccucgacaucuggggccagggcaccaccgucaucgucuccucc

SEQ ID NO: 17232 - RNA, 438 nt, Artificial Sequence
  derived and/or modified sequence opt2 from anti-HIV_cap256-119-026279_VR-Chain
cagaugcagcucgucgaguccggcggcggcgucguccagcccggcaccucccucacccucuccugcgccgccucccaguucuccuucaccuccuacggcaugcacuggguccgccaggcccccggcaagggccucgagugggucgccuccaucuccaacgacggcaccaagaaguaccacgccgaguccgucuggggccgcuucaccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacaucuggggccacggcaccgucgucaucgucuccucc

SEQ ID NO: 17233 - RNA, 432 nt, Artificial Sequence
  derived and/or modified sequence opt2 from anti-HIV_cap256-119-025355_VR-Chain
gagguccagcucgucgaguccggcggcggccucguccagcccggccgcucccuccgccucuccugcgccgccuccggcuucuccuucuccgacuacgccaugcacuggguccgccaggcccccggccagggccucgagugggucgccuucaucuccuacgacggcaccaagaaguaccacuccgacuccgucuggggccgccucaccaucucccgcgacaacucccgcaacacccucuuccuccagaugaacucccuccgcaccgaggacaccgcccucuacuucugcguccgcgaccagcgcgaggacgacugcgaggaguggugguccgacuacuacgacuucggcaagaagcuccccugccgcaagucccgcggccucgccggcaucuucgacaucuggggccacggcaccauggucaccgucuccucc

SEQ ID NO: 17234 - RNA, 432 nt, Artificial Sequence
  derived and/or modified sequence opt2 from anti-HIV_cap256-119-025301_VR-Chain
cagguccaccucgucgccuccggcggcggcgucgucccccccggccgcucccuccgccucuccugcgucgccucccaguucaccuucuccggcuucggccucuacuggguccgccaggcccccggcaagggccucgagugggucgccgccaucuccuucgccggcaccaagaagcacuacgccaacuccgucaagggccgcuucaccaucucccgcgacaacuccaagaacacccucuaccuccagaugaacucccuccgccccgacgacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17235 - RNA, 438 nt, Artificial Sequence
  derived and/or modified sequence opt2 from anti-HIV_cap256-119-025010_VR-Chain
cagguccagcucgucgaguccggcggcggcgucguccagcccggccgcucccuccgccucuccugccccgccuccggcuucuccuucuccaccuacggcaugcacuggguccgccaggcccccggcaagggccucgagugggucgccuccaucuccaacgacggcaacaagaaguaccacggcgaguccgucugggaccgcuucaccaucucccgcgacaacuccaagaacacccucuuccuccagaugaaccgccuccgcgucgaggacaccgcccucuacuucugcgucaaggaccagcgcgaggacgagugcgaggaguggugguccgacuacuacgacuucggccgcgagcuccccugccgcaaguuccgcggccucggccucgccggcaucuucgacgucuggggccacggcaccauggucaccgucuccucc

SEQ ID NO: 17236 - RNA, 432 nt, Artificial Sequence
  derived and/or modified sequence opt2 from anti-HIV_cap256-119-024631_VR-Chain
cagguccagcucauggaguccggcggcggcgucguccagcccggcggcucccuccgccucuccugcgccgccuccggcuucaccuucuccuccuacggcaugcacuggguccgccaggcccccggcaagggccucgagugggucgccggcaucuccuacgacggcuccgacaaguaccacgcccacuucgucuggggccgcuucaucaucucccgcgacaacuccaagaacgcccucuaccuccagaugaacucccuccgccccgaggacaccgcccucuacuucugcguccgcgaccuccgcgaguccgagugcgaggaguggcaguccuacuacuacgacuucggccgcaagggccccugccucaagccccgcggcgucgccggcuccuucgacaucuggggccagggcaccgucgucaccgucuccucc

SEQ ID NO: 17237 - RNA, 432 nt, Artificial Sequence
  derived and/or modified sequence opt2 from anti-HIV_cap256-119-024467_VR-Chain
gagguccagcucgucgaguccggcggcggccucguccagcccggcggcucccucaacgucuccugcgccgccuccggcuucaccuuccgcaccuacgccaugcacuggguccgccaggcccccggcaagggccucgagugggucgccgccaucuccuacgacggcgacaacaaguacuccgccgacuccgucaagggccgcuucaccaucucccgcgaccaguccaagaacacccucuaccuccagaugaacuccguccgcgucgaggacaccgcccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17238 - RNA, 432 nt, Artificial Sequence
  derived and/or modified sequence opt2 from anti-HIV_cap256-119-023805_VR-Chain
cagguccagcucgucgaguccggcggcggcgucguccagcccggcaagucccuccgccucuccugcgccgccucccaguucggcuucggcuccuacggcaugcacuggguccgccaggcccccggcaagggccucgagugggucgccaccaucuccuucgacggcgccgacaaguaccacgccgacgacgucuggggccgcuucuccaucucccgcgacaacuccaagaacacccucuaccuccagaugaacaaccuccgccccgaggacaccgcccucuacuacugcgccaaggaccuccgcgaggacgagugcgaggagcgcugguccgacuacuacgacuucggcaagcagcuccccugccgcaagucccgcggcgucgccggcgucuucgacaacuggggccagggcaccauggucaccgucuccucc

SEQ ID NO: 17239 - RNA, 432 nt, Artificial Sequence
  derived and/or modified sequence opt2 from anti-HIV_cap256-119-021736_VR-Chain
cagguccagcucgucgaguccggcggcggcgucguccagcccggccgcuccguccgccucuccugcgucgccucccaguucuccuucgaccgcuacggcaugcacuggguccgccaggcccccggcaagggccucgagugggucgccuccaucuccuacgacggcaccgacaaguaccacgccgacaaggucuggggccgcuucaccaucucccgcgacaacuccaagaagacccucuaccuccagaugaacucccuccgccccgaggacgccgcccucuacuacugcgccaaggaccuccgcgaggacgagugcgaggaguggugguccgacuacuacgacuucggcaagcagcuccccugccgcaagucccgcggcgucgccggcaucuucgacuccuggggccagggcaccauggucaccgucuccucc

SEQ ID NO: 17240 - RNA, 438 nt, Artificial Sequence
  derived and/or modified sequence opt2 from anti-HIV_cap256-119-021203_VR-Chain
cagaugcagcucgucgaguccggcggcggcgucguccagcccggccgcucccucacccucuccugcgccgccucccaguucaccuucuccaacuacggcaugcacuggguccgccaggcccccggcaagggccucgagugggucgccuccgucuccaacgacggcaccaagaaguaccacggcgacuccgucugggaccgcuucaccaucucccgcgacaacuccaagaacacccucuuccuccagauguccucccuccgcgccgaggacaccgccgucuacuucugcguccgcgacgagcgcgaggacgagugcgaggaguggugguccgacuacuacgacuucggccgcgagcuccccugccgcaaguuccgcggccucggccucgccggcaucuucgacaucuggggccacggcacccucgucaccgucuccucc

SEQ ID NO: 17241 - RNA, 432 nt, Artificial Sequence
  derived and/or modified sequence opt2 from anti-HIV_cap256-119-020569_VR-Chain
cagguccagcucgucgaguccggcggcggcgucguccagcccggcgagucccuccgcaucuccugcgccgccucccaguucaccuucucccgcuacggcaugcacuggguccgccaggcccccggcaagggccucgagugggucgccuccaucuccuucgacggccgcgacaaguaccacuccucccucgucuggggccgccucaccaucucccgcgacaacuccaaguccacccucuuccuccagaugaacucccuccgccccgaggacaccgcccucuacuacugcgcccgcgacguccgcgaguccgagugcgaggaguggcaguccgacuacuacgccuucuaccgcaagcuccccugcgucaagccccgcggcgucgccggcacccucgacaucuggggccagggcaccauggucaccgucuccucc

SEQ ID NO: 17242 - RNA, 432 nt, Artificial Sequence
  derived and/or modified sequence opt2 from anti-HIV_cap256-119-019432_VR-Chain
cagguccagcucguccaguccggcggcggcgucguccagcccggccgcucccuccgcaucuccugcgccgcccccuacuucaccuucggccgcuacggcuuccacuggguccgccaggcccccggcaagggccucgagugggucgccuccaucuccuucgacggccgcgacuacuaccacuccccccacgucuggggccgccucaccaucucccgcgacaacuccaagaacacccucuaccuccagaugaacucccuccgcgccgaggacaccgcccucuacuacugcgcccgcgaccuccgcgaguccgagugcgaggagugggaguccgacuacuacgacuucggcaagaagggccccugcgucaagccccgcggcgucgccggcucccucgacauguggggccagggcaccauggucaccgucuccucc

SEQ ID NO: 17243 - RNA, 432 nt, Artificial Sequence
  derived and/or modified sequence opt2 from anti-HIV_cap256-119-018827_VR-Chain
caggcccagcucgucgaguccggcggcggcgucguccagcccggccgcucccuccgccucuccugcgccgccucccacuucuccuucaaccgcuacggcaugcacuggguccgccaggcccccggcaagggccucgagugggucgccggcaucuccuacgacggccgcgacuucuaccacgccgacaucgucuggggccgccucaccaucucccgcgacaacuccaagaacaccgucuaccuccagaugaacucccuccgcgccgacgacaccggccucuacuacugcgcccgcgacguccgcgaguccgagugcgaggagugggaguccuacuacuacgacuucggccgcaagggccccugccucaagccccgcggcgucgccggcaccuucgacauguggggccagggcaccaucgucuccgucuccgcc

SEQ ID NO: 17244 - RNA, 432 nt, Artificial Sequence
  derived and/or modified sequence opt2 from anti-HIV_cap256-119-018483_VR-Chain
cucguccagcucgucgaguccggcggcggcgucguccagcccggcaagucccuccgccucuccugcgucgccucccaguucaccuucaaccgcuacggcaugcacuggguccgccaggcccccggcaagggccucgagugggucgccggcaucuccuacgacggccgcgacaaguaccacgcccacuucgucuggggccgcaucaccaucucccgcgacaacuccaagaacacccucuaccuccagaugaacucccuccgcgccgaggacaccgcccucuaccacugcguccgcgaccuccgcgaguccgagugcgagcucugggaguccgacuacuacgacuucggcaagaagcuccccugcgucaagccccgcggcgucgccggcaucuucgaccucuggggccagggcaccauggucaccgucuccucc

SEQ ID NO: 17245 - RNA, 432 nt, Artificial Sequence
  derived and/or modified sequence opt2 from anti-HIV_cap256-119-018118_VR-Chain
cagguccaccucgucgccuccggcggcggcgucgucccccccggccgcucccucacccucuccugcgucgccucccaguucaccuucuccggcugcggccuccacuggguccgccaggcccccggcaagggccucgagugggucgccuccaucuccuucgccggcaccaagaagcacuacggcaacuccgucaagggccgcuucaccaucucccgcgacaacuccaagaacacccucuaccuccagaugaacucccuccgccccgaggacaccgcccucuacuacugcgccaaggaccuccgcgaguacgagugcgaggaguggaccuccgacuacuacgacuucggccgcgaccagcccugcaucgacucccgcggcgucgucggcauccucgacaucuggggccagggcaccauggucaccgucuccucc

SEQ ID NO: 17246 - RNA, 432 nt, Artificial Sequence
  derived and/or modified sequence opt2 from anti-HIV_cap256-119-017782_VR-Chain
cagguccagcucgucgaguccggcggcggcgucguccagcccggcaagucccuccgccucuccugcgccgccuccggcuuccccuucuccaacuacgccaugcacuggguccgccagacccccggccgcggccucgagugggucgccggcaucuccuucgccgccaccaagaaguacuaccgccccuccguccgcggccgcuucaccgucuccaccgacaucuccaagaacacccucuaccucgagaugaacucccuccgccccgaggacaccgcccucuacuucugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 17247 - RNA, 432 nt, Artificial Sequence
  derived and/or modified sequence opt2 from anti-HIV_cap256-119-017669_VR-Chain
cagguccagcucgucgaguccggcggcggcgucguccagcccggcuccucccuccgccucuccugcgccgccucccacuucgccuucaaccgcuacggcaugcacuggguccgccaggcccccggcaagggccucgagugggucgccggcaucuccuucgacggcgccgacaaguuccacgccgacaaggucuggggccgcuucaccaucucccgcgacaacuccaagaacacccucucccuccagaugaacucccuccgccccgaggacaccgcccucuacuacugcgccaaggaccuccgcgaggacgagugcgaggaguggugguccgacuacuacgacuucggccgccgccuccccugccgcaagucccgcggcgucuccggcaucuucgacaacuggggccagggcaccauggucaccgucuccucc

SEQ ID NO: 17248 - RNA, 432 nt, Artificial Sequence
  derived and/or modified sequence opt2 from anti-HIV_cap256-119-016976_VR-Chain
cagguccagcucgucgaguccggcggcggcgucguccagcccggccgcucccuccgccucuccugcgccgccucccaguucuccuucggcgacuucggcaugcacuggguccgccaggcccccggcaagggccucgagugggucgccgccaucuccuucgccggcaccaagaagaacuacgccgacuccguccgcggccgcuucaccaucucccgcgacuccuccaagaacacccucuaccuccagaugaacucccuccgccccgaggacaccgcccucuacuacugcgucaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17249 - RNA, 432 nt, Artificial Sequence
  derived and/or modified sequence opt2 from anti-HIV_cap256-119-015432_VR-Chain
gagguccagcuccucgaguccggcggcggccucguccagcccggcggcucccuccgccucuccugcgccgccuccggcuucaccuucuccggcuacucccucaacuggguccgccaggcccccggcaagggccucgagugggucgccuccaucuccuacgacggcuccgacaaguaccacgccgaccgcgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17250 - RNA, 432 nt, Artificial Sequence
  derived and/or modified sequence opt2 from anti-HIV_cap256-119-015281_VR-Chain
cucggccgccucgucgccuccggcggcggcgucgucccccccggccgcucccuccgccucuccugcgucgccucccaguucaccuucuccggcugcggccuccacuggguccgccaggcccccggcaagggccucgagugggucgccuccaucuccuucgccggcaccaagaagcacuacggcaacuccgucaagggccgcuucaccaucucccgcgacaacuccaagaacaccgucuaccucgagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggggccagggcaccauggucaccgucuccucc

SEQ ID NO: 17251 - RNA, 432 nt, Artificial Sequence
  derived and/or modified sequence opt2 from anti-HIV_cap256-119-014957_VR-Chain
cagguccaggucgucgaguccggcggcggcgucguccagcccggcaccucccuccgccucuccugcaccgucuccggcuucuccuucuccaacuacgaccuccacuggguccgccagacccccgccaagggccucgagugggucgccgucgucuccuacgacggcucccgcgaguacuacaccgacuccgucaagggccgcuucaucaucucccgcgaccaguccaagaacacccucuaccuccagaugaacuccguccgccucgaggacaccgcccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17252 - RNA, 432 nt, Artificial Sequence
  derived and/or modified sequence opt2 from anti-HIV_cap256-119-014777_VR-Chain
cagguccaccucgucgaguccggcggcggcgucguccagcccggccgcucccuccgccucuccugcgccgccucccacuucucccucuccuccuacggcaugcacuggguccgccaggcccccggcaagggccucgagugggucgccggcaucuccuucgccgccaccaagaccuacuacggcggcuccgucaagggccgcuucaccgucucccgcgacaucuccaagaacacccucuaccuccagaugaacucccuccgccccgaggacaccgccauguacuacugcgcccgcgaccagcgcuacuacgagugcgaggagugggccuccgacuacuacgacuucggccgcgagcagcccugccaggacccccgcggcgucgucggcgucuucgacauguggggccagggcaccauggucaccgucuccucc

SEQ ID NO: 17253 - RNA, 432 nt, Artificial Sequence
  derived and/or modified sequence opt2 from anti-HIV_cap256-119-014313_VR-Chain
cagguccagcucgucgaguccggcggcggcgucguccagcccggccgcucccuccgcaucuccugcgccgccucccaguucaccuucucccgcuacggcaugcacuggguccgccaggcccccggcaagggccucgagugggucgccuccaucuccuacgacggccgcgacuaccaccacgccggcgccgucuggggccgcuucaucaucucccgcgacaacuccaagaacucccuccaccuccagaugaacucccuccgccccgaggacaccgcccucuacuucugcgcccgcgaccuccgcgaguccgagugcgaggagugggaguccgacuacuacaacuucuggaagaagcuccccugcgucaagccccgcggcgucgucggcauccucgacaucuggggccagggcaccgucgucaccgucuccucc

SEQ ID NO: 17254 - RNA, 438 nt, Artificial Sequence
  derived and/or modified sequence opt2 from anti-HIV_cap256-119-014219_VR-Chain
cagaugcagcucgucgaguccggcggcggcgucguccagcccggcuccucccucacccucuccugcgccgccucccaguucaccuucuccaacuacggcaugcacuggguccgccaggcccccggcaagggccucgagugggucgccuccaucuccaacgacggcaccaagaaguaccacggcgacuccgucugggaccgcuucaccaucucccgcgacaacuccaagaacacccucuuccuccagaugaacucccuccgcgccgaggacaccgcccucuacuucugcgucaaggaccagcgcgaggacgagugcgaggaguggugguccgacuacuacgacuucggccgcgagcuccccugccgcaaguuccgcggccucggccucgccggcaccuucgacaucuggggccacggcaccaugcucaucgucuccucc

SEQ ID NO: 17255 - RNA, 432 nt, Artificial Sequence
  derived and/or modified sequence opt2 from anti-HIV_cap256-119-013631_VR-Chain
cagguccagcucgucgaguccggcggcggcgucguccagcccggccgcucccuccgccucuccugcgccgccucccaguucaccuucggcuccuacggcaugcacuggguccgccagauccccggcaagggccucgagugggucgccaccaucuccuacgacggcaccaagaaguaccacgccgacuccgucugggaccgcuucaucaucucccgcgacaacuccaagaacacccucuuccuccagaugaacucccuccgccccgaggacaccgcccucuacuucugcgucaaggaccagcgccaggacgagugcgaggaguggugguccgacuacuacgacuucggccgccgccuccccugccgcaagucccgcggccucgccggcaucuucgacgucuggggccacggcaccauggucaccgucuccucc

SEQ ID NO: 17256 - RNA, 432 nt, Artificial Sequence
  derived and/or modified sequence opt2 from anti-HIV_cap256-119-012924_VR-Chain
caggucacccucgucgaguccggcggcggcuucguccagcccggcggcucccuccgccucuccugcgccaccuccggcuucaccuucuccuccuacgccaugcacuggguccgccaggcccccggcaagggccucgagugggucgccgccaucuccuucgacggcgccgacaaguaccacgccgacaacgucuggggccgccucuccaucucccgcgacaacuccaaguccacccucuaccuccagaugaacucccuccgccccgaggacaccgccgucuacuucugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccgcc

SEQ ID NO: 17257 - RNA, 432 nt, Artificial Sequence
  derived and/or modified sequence opt2 from anti-HIV_cap256-119-011793_VR-Chain
cagguccagcucgucgaguccggcggcggcgucguccagcccggcggcucccuccgccucuccugcgucgccucccaguucaccuucucccgcuacggcaugcacuggguccgccaggcccccggcaagggccucgagugggucgccuccaucuccuacgacggccgcgacaaguaccacgccgacuucgucuggggccgccucaccaucucccgcgacgacuccaagaagacccucuaccuccagauggacucccuccgcgucgacgacaccgcccucuacuacugcguccgcgacaugcgcgaguccgagugcgagcucugggaguccgacuacuacgacuucggcaagcgccuccccugcgucaagccccgcggcgucgccggcaucuucgacaucuggggccagggcaccauggucaccgucuccucc

SEQ ID NO: 17258 - RNA, 432 nt, Artificial Sequence
  derived and/or modified sequence opt2 from anti-HIV_cap256-119-011413_VR-Chain
cagguccagcucgucgaguccggcggcgacgucguccagcccggccgcucccuccgccucuccugcgccgccuccggcuucaccuucuccaccuacggcaugcacuggguccgccaggcccccggcaagggccucgagugggucgccgccaucuccuucgccggcaccaagaagaacuacgccgacuccguccgcggccgcuucaccaucucccgcgacuccuccaagaacacccucuaccucgagaugaacucccuccgccccgaggacaccgcccucuacuacugcgccaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17259 - RNA, 432 nt, Artificial Sequence
  derived and/or modified sequence opt2 from anti-HIV_cap256-119-011323_VR-Chain
caggucaagcucgucgaguccggcggcggcgucgucccccccggcaagucccuccgccucuccugcaccgccucccaguucaccuucuccaacuucggcaugcacuggguccgccaggcccccggcaagggccucgagugggucgccuccaucuccuucgucggcaucaagacccacuacgccaacuccguccgcggccgcuucaccaucucccgcgaccaguccaagaacacccucuaccuccagaugaacuccguccgcgucgaggacaccggccgcuacuacugcgcccgcgacaugcgcgaguacgagugcgagcucugggccuccgacuacuacgacuucggcaagccccagcccugcgaggacccccgcggcgucgucggcaccuucgacauguggggccucggcacccucgucaccgucuccucc

SEQ ID NO: 17260 - RNA, 432 nt, Artificial Sequence
  derived and/or modified sequence opt2 from anti-HIV_cap256-119-011233_VR-Chain
cagguccaccucgucgaguccggcggcggcgucguccagcccggccgcuccguccgccucuccugcgccgccucccacuucucccucuccuccuacggcaugcacuggguccgccaggcccccggcaagggccucgagugggucaccggcaucuccuucgccggcaccaagaccuacuacggcgacuccguccgcggccgcuucaccgucucccgcgacaucuccaagaacacccucuuccuccagaugaacucccuccgccccgacgacaccgccauguacuacugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 17261 - RNA, 432 nt, Artificial Sequence
  derived and/or modified sequence opt2 from anti-HIV_cap256-119-009038_VR-Chain
caggagcagcucgucgaguccggcggcggcgucguccagcccggccgcucccuccgccucuccugcgucgccucccgcuucaccuucuccgccuucggcaugcacuggguccgccaggcccccggcaagggccucgagugggucgccuccaucuccuucgccggcaucaagaaguacuacggcgacuccgucaagggccgcuucaccaucucccgcgacaacuccaagaacacccucuaccuccagauggacggccuccgcggcgaggacaccgcccucuacuacugcgccaaggaccuccgcgagcucgagugcgaggagugggccuccgacuacuacgacuucggccgcccccagcccugccucgacccccgcggcgucuccggcaucuccaacgucuggggccagggcaccauggucaccgucuccucc

SEQ ID NO: 17262 - RNA, 432 nt, Artificial Sequence
  derived and/or modified sequence opt2 from anti-HIV_cap256-119-008756_VR-Chain
cagguccagcucgucgaguccggcggcggcgucguccagcccggcaagucccuccgccucuccugcgucgucucccaguucaccuucggccgcuacggcaugcacuggguccgccaggcccccggcaagggccucgagugggucgccuccaucuccuacgacggcuccgacaaguaccacaccuccucccucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17263 - RNA, 438 nt, Artificial Sequence
  derived and/or modified sequence opt2 from anti-HIV_cap256-119-008055_VR-Chain
cagaugcagcucgucgaguccggcggcggcgucguccagcccggccgcucccucacccucuccugcgccgccucccaguucuccuucgccaacuacggcaugcacuggguccgccaggcccccggcaagggccucgagugggucgccuccaucuccaacgacggcaccaagaaguaccacgaggaguccgucuggggccgcuucaccaucuccaaggacaacuccaagaacacccucuuccuccagaugaacucccuccgcaucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17264 - RNA, 435 nt, Artificial Sequence
  derived and/or modified sequence opt2 from anti-HIV_cap256-119-006949_VR-Chain
cagguccaccucgucgaguccggcggcggcgucguccagcccggccgcucccuccgccucuccugcgccgccuccggcuucuccgucuccaacaacuacaugaacuggguccgccaggcccccggcgagggccucgagugggucgcccucaucuccuucgacggccgccagaaggaccucgccgacuccgucaagggccgcuucgccaucucccgcgacaacuccaagaacacccucuaccuccagaugaacucccuccgccucgaggacaccgcccucuacuacugcgcccgcgaccuccgcgagcucgacugcgaggaguggacccucuacaacuacuacgacuucggcucccgcggccccugcgucgacccccgcggcgucggcggcuccuucgacgucuggggccagggcaccauggucaccgucuccucc

SEQ ID NO: 17265 - RNA, 432 nt, Artificial Sequence
  derived and/or modified sequence opt2 from anti-HIV_cap256-119-006685_VR-Chain
cagguccagcucgucgaguccggcggcggcgucguccagcccggccgcucccuccgcgucuccugcgccgccucccacuucaccuucucccgcuacggcaugcacuggguccgccaggcccccggcaagggccucgagugggucgccuccaucuccuacgacggccgcgacuucuaccacgcccgcuccgucuggggccgcuucaccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17266 - RNA, 432 nt, Artificial Sequence
  derived and/or modified sequence opt2 from anti-HIV_cap256-119-006015_VR-Chain
cagguccagcucgucgaguccggcggcggcgucguccagcccggcaagucccuccgccucuccugcgccgccucccgcuucaccuucaaccgcuacggcaugcacuggguccgccaggcccccggcaagggccucgagugggucgccgccaucuccuucgacggcaccgacaaguaccacuccgacgacgucuggggccgcuucaccaucucccgcgacaacuccaagaacacccucuaccuccagaugaacucccuccgccccgaggacaccgcccucuacuacugcgccaaggaccuccaggaggacgagugcgaggaguggugguccgacuacuacgacuucggcaagcagcuccccugccgcaagucccgcggcgucgccggcaucuucgacgacuggggccagggcaccauggucaccgucuccucc

SEQ ID NO: 17267 - RNA, 432 nt, Artificial Sequence
  derived and/or modified sequence opt2 from anti-HIV_cap256-119-005841_VR-Chain
cagguccagcucgucgaguccggcggcggcgucguccagcccggccgcucccuccgccucuccugcgccgccucccaguucuccuucggcaacuucggcaugcacuggguccgccaggcccccggcaagggccucgagugggucgccgccaucuccuucgccggcaccaaggagaacuacgccaacuccguccgcggccgcuucaccaucucccgcgacaacuccaagaacacccucuaccuccagaugaacucccuccgcgccgaggacaccgcccucuacuacugcaccaaggacaugcgcgaguacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17268 - RNA, 432 nt, Artificial Sequence
  derived and/or modified sequence opt2 from anti-HIV_cap256-119-005824_VR-Chain
cagguccagcucgucgaguccggcggcggcgucguccagcccggcggcucccuccgccucuccugcgccgccuccggcuucaccuuccgccgcuacgccaugcacuggguccgccaggcccccggcaagggccucgagugggucgccuccaucuccuacgacggcuccgacaaguaccacaccuccucccucuggggccgcuucaucgucucccgcgacaacuccaagaacacccucuaccuccagaugaacucccuccgccccgaggacaccgcccucuacuacugcguccgcgaccgccgcgaguccgagugcgaggagcgcugguccgacuacuacgacuucggcaagcagcuccccugcgucaagccccgcggcgucgccggcaucuucgacaucuggggccagggcaccauggucaccgucuccucc

SEQ ID NO: 17269 - RNA, 432 nt, Artificial Sequence
  derived and/or modified sequence opt2 from anti-HIV_cap256-119-005494_VR-Chain
cagguccgccucgucgaguccggcggcggcgucguccagcccggccgcucccuccgcaucuccugcgccgccucccaguucauguucaacaaguacggcaugcacuggguccgccaggcccccggcaagggccucgagugggucgccuccaucuccuacgacggcuccgacaaguaccacgccgaccucgucuggggccgcuucaccaucucccgcgacaacuccaagaacacccucuaccuccagaugaacucccuccgcgccgaggacaccgcccucuacuacugcguccgcgacgcccgcgaguccgagugcgagcucugggaguccgacuacuacaacuucggccgcaagcuccccugcgucaagccccgcggcgucgccggcacccucgacaucuggggccagggcaccauggucaccgucuccucc

SEQ ID NO: 17270 - RNA, 432 nt, Artificial Sequence
  derived and/or modified sequence opt2 from anti-HIV_cap256-119-004949_VR-Chain
cagguccagcucgucgaguccggcggcggcgucguccagcccggccgcucccuccgccucuccugcgccgccuccaaguucucccucuccuccuacggcaugcacuggguccgccaggcccccggccgcggccucgagugggucgccggcaucuccuucgccgccaccaagaaguacuaccgccccuccguccgcggccgcuucaccgucuccaccgacaucuccaagaacacccucuaccucgagaugaacucccuccgccccgaggacaccgcccucuacuucugcgcccgcgaccagcgcuacuacgagugcgaggagugggccuccgacuacuacgacuucggccgcgagcagcccugccucgacccccgcggcgucgucggcaucuucgaccucuggggccagggcaccauggucaccgucuccucc

SEQ ID NO: 17271 - RNA, 432 nt, Artificial Sequence
  derived and/or modified sequence opt2 from anti-HIV_cap256-119-004422_VR-Chain
cacguccagcucgucgaguccggcggcggcgucguccagcccggccgcucccuccgccucuccugcgccgccuccggccucuccuucuccuccuacgccaugcacuggguccgccaggcccccggcaagggccucgagugggucgccgucgucuccuacgacggcaccaccaaguucuacgccgacuccgucaagggccgcuucaccaucucccgcgacaacuccaagaacacccucuaccuccagaugaacucccuccgcggcgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17272 - RNA, 432 nt, Artificial Sequence
  derived and/or modified sequence opt2 from anti-HIV_cap256-119-003932_VR-Chain
cagguccagcuccucgaguccggcggcggcgucguccagcccggcggcucccuccgccucuccugcaaggccucccacuucuccuucgaccgcuacggcaugcacuggguccgccaggcccccggcaagggccucgagugggucgccgccaucuccuucgacggcgccgacaaguaccacgccgacaacgucuggggccgccucuccaucucccgcgacaacuccaaguccacccucuaccuccagaugaacucccuccgccccgaggacaccgccgucuacuucugcgccaaggaccuccgcgaggacgagugcgaggagcgcugguccgacuacuacgacuucggcaagcagcuccccugccgcaagucccgcggcgucgccggcaucuucgacaacuggggccagggcaccauggucaccgucuccgcc

SEQ ID NO: 17273 - RNA, 438 nt, Artificial Sequence
  derived and/or modified sequence opt2 from anti-HIV_cap256-119-003577_VR-Chain
cagguccagcucgucgaguccggcggcggcggcguccagcccggccgcucccuccgccucuccugcgccgccuccggcuucaccuuccgcuccuacgccaugcacuggguccgccaggcccccggcaagggccucgagugggucgccgucaucuccaacgacggcaccaagaaguaccacgccgaguccgucugggaccgcuucuccaucuccaaggacaacuccaagaacacccucuuccuccagaugaacucccuccgcgucgaggacaccgcccucuacuucugcgucaaggaccagcgcgaggacgagugcgaggaguggugguccgacuacuacgacuucggccgcgagcuccccugccgcaagucccgcggccucggccucgccggcaucuucgacauguggggccacggcaccauggucaccgucuccucc

SEQ ID NO: 17274 - RNA, 432 nt, Artificial Sequence
  derived and/or modified sequence opt2 from anti-HIV_cap256-119-002155_VR-Chain
cucggccgccucgucgccuccggcggcggcgucgucccccccggccgcucccuccgccucuccugcgucgccucccaguucaccuucuccggcugcggccuccacuggguccgccagguccccggcaagggccucgagugggucgccuccaucuccuucgccggcaccaagacccacuacggcaacuccgucaagggccgcuucuccaucucccgcgacaacuccaucaacaccgucuaccuccagaugaacucccuccgcgccgaggacaccgcccucuacuacugcgccaaggaccuccgcgaguacgagugcgaggaguggaccuccgacuacuacgacuucggccgcccccagcccugcaucgacucccgcggcgucgucggcauccucgacaucuggucccagggcaccauggucaccgucuccucc

SEQ ID NO: 17275 - RNA, 432 nt, Artificial Sequence
  derived and/or modified sequence opt2 from anti-HIV_cap256-119-002017_VR-Chain
cagguccagcucgucgaguccggcggcggcgucguccagcccggccgcucccuccgccucuccugcgccgccuccggcuucaccuucuccuacuacggcauccacuggguccgccaggcccccggcaagggccucgagugggucgccuccaucuccuacgacgagcgcgacuucuaccacgcccgcuccgucuggggccgcuucgccaucucccgcgacaacuccaagaacacccuccaccuccagaugaacucccuccgccccgaggacaccgcccucuacuucugcgcccgcgaccuccgcgaguccgagugcgaggagugggaguccuacuacuacgacuucggcaagaagggccccugcgucaagccccgcggcgucgucggcguccucgacaucuggggccagggcacccucgucaccgucuccucc

SEQ ID NO: 17276 - RNA, 432 nt, Artificial Sequence
  derived and/or modified sequence opt2 from anti-HIV_cap256-119-001312_VR-Chain
cagguccagcucauggaguccggcggcggcgucguccagcccggccgcucccuccgccucgccugcgccgccuccggcuucaccuucuccuccuacgccauccacuggguccgccaggcccccggcaagggccucgagugggucgccgccaucuccuucgccggcaccaagaagaacuacgccgacuccguccgcggccgcuucaccaucucccgcgacuccuccaagaacacccucuaccucgagaugaacucccuccgccccgaggacaccgcccucuacuacugcgccaaggacaugcgcggcuacgagugcgaggaguggaccuccgacuacuacgacuucggccgcccccagcccugcaucgacucccgcggcgucgucggcaccuucgacgucuggggccagggcaccauggucaccgucuccucc

SEQ ID NO: 17277 - RNA, 438 nt, Artificial Sequence
  derived and/or modified sequence opt2 from anti-HIV_cap256-119-001017_VR-Chain
cagaugcagcucgucgaguccggcggcggcgucguccagcccggccgcucccucacccucuccugcgccgccucccaguucuccuucaccaacuacggcaugcacuggguccgccaggcccccggcaagggccucgagugggucgccuccaucuccaacgacggcaacaagaaguaccacggcgaguccgucugggaccgcuucaccaucucccgcgacaacuccaagaacacccucuuccuccagaugaaccgccuccgcgucgaggacaccgcccucuacuucugcgucaaggaccagcgcgaggacgagugcgaggaguggugguccgacuacuacgacuucggccgcgagcuccccugccgcaaguuccgcggccucggccucgccggcaucuucgacgucuggggccacggcaccauggucaccgucuccucc

SEQ ID NO: 17278 - RNA, 432 nt, Artificial Sequence
  derived and/or modified sequence opt2 from anti-HIV_cap256-119-000594_VR-Chain
cagguccagcucgucgaguccggcggcggccucguccagcccggcaccucccuccgccucuccugcgccgccuccgccuucaccuucaagaacuacggcaugcacuggguccgccaggcccccggcaagggccucgacugggucgccuccaucuccuacgacggccgcgacaaguaccacuccucccucgucuggggccgccucaccaucucccgcgacaacuccaaguccacccucuuccuccagaugaacucccuccgcgccgaggacaccgcccucuacuacugcgcccgcgaccuccgcgaguccgagugcgaggaguggcaguccgacuacuacgccuucuacaagaagcuccccugcgucaagccccgcggcgucgccggcacccucgacaucuggggccagggcaccauggucaccgucuccucc

SEQ ID NO: 17279 - RNA, 432 nt, Artificial Sequence
  derived and/or modified sequence opt2 from anti-HIV_cap256-059-241099_VR-Chain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucaucuccuacgacggcuccaacaaguacuacgucgacuccguccagggccgcuucaccaucucccgcgacaacuccaagaacaccauguuccuccagaugaacucccuccgcaccgaggacaccgccgucuacuacugcgcccgcgaccucggcgaguccgaggucgaggagugggccaccgacuacuacgacuucuccaucgccuaccccgucgagggcccccgcggcgucgucggcaucuucgacaucuggggccagggcaccauggucaccgucuccucc

SEQ ID NO: 17280 - RNA, 432 nt, Artificial Sequence
  derived and/or modified sequence opt2 from anti-HIV_cap256-059-207529_VR-Chain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccggcaucuccuucgccggcaucaacaaguacuacggcaacuccgucaagggccgcuucaccaucucccgcgacaacucccgcaacacccucuaccuccagaugaacucccuccgcgccgaggacaccgcccucuacuacugcgcccgcgaccuccgcgagauggagugcgaggagugggccuccgacuacuacgacuucggccgcggcggccccugccaggacccccgcggcgucgucggcaccuucgacaucuggggccagggcaccauggucaccgucuccucc

SEQ ID NO: 17281 - RNA, 435 nt, Artificial Sequence
  derived and/or modified sequence opt2 from anti-HIV_cap256-059-205541_VR-Chain
cagaugcagcucgucgaguccggcggcggcgucguccagcccggcggcucccuccgccucuccugcgccgccuccggcuucuccuucuccuacuacgccauggacuggguccgccaggcccccggcaagggccucgagugggucgccuucaucuccuccgacggcuccgacaagaacuacgccgacuccgucaagggccgcuucaccaucucccgcgacaacuccaagaacacccucuaccuccagaugaacucccuccgcgccgaggacaccgccgucuacuacugcgccaaggacgucggcggccacaagaacgacgagugggccaccaacuacuacuacgacaucuccaucgccuaccccauccaggacccccgcgccgucgccggcgccuucgacgucuggggccagggcaccauggucaccgucuccucc

SEQ ID NO: 17282 - RNA, 432 nt, Artificial Sequence
  derived and/or modified sequence opt2 from anti-HIV_cap256-059-188439_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccgccaucuccuucgccggcaucaacaaguacuacaccgacuccgucaagggccgcuucaccaucucccgcgacaacuccaagaacacccucuaccuccagaugaacucccuccgcgccgaggacaccgcccucuacuacugcgccaaggaccuccgcggcuucgagugcgaggagugggccuccgacuacuacgacuucggccgcgaccuccccugccaggacccccgcggcgucgucggcaccuucgacgucuggggccagggcaccaaggucaccgucuccucc

SEQ ID NO: 17283 - RNA, 432 nt, Artificial Sequence
  derived and/or modified sequence opt2 from anti-HIV_cap256-059-187234_VR-Chain
cagguccagcucgucgaguccggcggcggcgucguccaggccggccgcucccuccgccucuccugcgccgccucccaguucaccuucggcuccuacggcaugcacuggguccgccaggcccccggcaagggccucgagugggucgccgccaucuccuucgccggcaccaagauccacuacgccgacuccgucaagggccgcuucaccaucucccgcgacaacuccaagaacgcccucuaccuccagaugcacucccuccgcgccgaggacaccgcccucuacuacugcgccaaggaccuccgcgaguacgagugcgaggagugggccuccgacuacuacgacuucggccgcgaccagcccugccaggacccccgcggcgucgucggcaucuucgacaucuggggccagggcaccauggucaccgucuccucc

SEQ ID NO: 17284 - RNA, 432 nt, Artificial Sequence
  derived and/or modified sequence opt2 from anti-HIV_cap256-059-187047_VR-Chain
cagguccagcucgucgaguccggcggcggcgucguccagcccggccgcucccuccgccucuccugcgccgucucccagcucaccuucuccuccuacggcaugcacuggguccgccaggcccccggcaagggccucgagugggucgccgccaucuccuucgucggcaucaagaaguacuacgccgacuccgucaagggccgcuucaccaucucccgcgacaacuccaagaacacccucuaccuccagaugaacucccuccgcgucgaggacaccgcccucuacuacugcgccaaggaccuccgcgaguacgagugcgaggagugggccuccgacuacuacgacuucggccgcgaccagcccugccaggacgcccgcggcgucgucggcaccuccgacaucuggggccagggcaccauggucaccgucuccucc

SEQ ID NO: 17285 - RNA, 432 nt, Artificial Sequence
  derived and/or modified sequence opt2 from anti-HIV_cap256-059-186068_VR-Chain
cagguccagcucgucgaguccggcggcggcgucguccagcccggccgcucccuccgccucuccugcgccgccucccaguucuccuucuccaacuacggcaugcacuggguccgccaggcccccggcaagggccucgagugggucgccggcaucuccuucgccgccaccaagaaguacuacgccgacuccgucaagggccgcuucuccgucucccgcgacaacuccaagaacgcccucuaccuccagaugaacucccuccgcgccgaggacaccgcccucuacuacugcgcccgcgaccuccgcgacuacgagugcgaggagugggccuccgacuacuacgacuucggccgcgaguaccccugccaggacccccgcggcgucgucggcaccuucgacaucuggggccagggcaccauggucaccgucuccacc

SEQ ID NO: 17286 - RNA, 435 nt, Artificial Sequence
  derived and/or modified sequence opt2 from anti-HIV_cap256-059-182835_VR-Chain
cagguccagcucgucgaguccggcggcggccucguccagcccggccgcucccuccgccucuccugcgccgccuccggcuucuccuucaacaacuucgccauggacuggguccgccaggcccccggcaagggccucgagugggucgccuucgucuccuccgacggcuccaacaagaacuacgccgacuccgucaagggccgcuucaucaucucccgcgacaacuccaagaacaccgucuaccuccagaugaacucccuccgcgucgaggacaccgccgucuacuacugcgccaaggaccucggcgccaacaaggacgacgagugggccaccgacuacuacuacgaccucuccgucgcccgccccguccccgacccccgcgccgucgucggcgccuucgacgucuggggccagggcaccauggucaccgucuccucc

SEQ ID NO: 17287 - RNA, 432 nt, Artificial Sequence
  derived and/or modified sequence opt2 from anti-HIV_cap256-059-176659_VR-Chain
cgcguccagcucgucgaguccggcggcggcgucguccagcccggccgcucccuccgccucuccugcgccgccucccaguucuccuucuccaacuacggcaugcacuggguccgccaggcccccggcaagggccucgagugggucgccggcaucuccuucgccgccaucaagaaguacuacgccgacuccgucaagggccgcuucaccaucucccgcgacaacuccaagaacgcccucuaccuccagaugaacucccuccgcgccgaggacaccgcccucuacuacugcgcccgcgaccuccgcgaguacgagugcgaggagugggccuccgacuacuacgacuucggccgcgagcuccccugccaggacccccgcggcgucgucggcaccuucgacaccuggggccagggcaccauggucaccgucuccacc

SEQ ID NO: 17288 - RNA, 432 nt, Artificial Sequence
  derived and/or modified sequence opt2 from anti-HIV_cap256-059-172956_VR-Chain
cagguccagcucgucgaguccggcggcggcgucguccagcccggccgcucccuccgccucuccugcgccgccucccaguucuccuucuccuccuacggcaugcacuggguccgccaggcccccggcaagggccucgagugggucgccgccauguccuucgccggcaccaaccaguacuacgccgccuccgucaagggccgcuucaccaucucccgcgacaacuccaagaacacccucuaccuccacaugaacucccuccgccccgaggacaccgcccucuacuacugcgcccgcgaccuccgcgaguacgagugcgaggagugggccgccgacuacuacgacuucggccgcgaguaccccugccaggacccccgcggcgucgucggcaucuucgacgucuggggccagggcacccucgucaccgucuccucc

SEQ ID NO: 17289 - RNA, 432 nt, Artificial Sequence
  derived and/or modified sequence opt2 from anti-HIV_cap256-059-171272_VR-Chain
cagguccuccucgucgaguccggcggcggcgucguccagcccggccgcucccuccgccucuccugcgccgccucccaguucaccuucuccaacuacggcaugcacuggguccgccaggcccccggcaagggccucgagugggucgccgccaucuccuucgccggcaugaagaaguacuacgccgacuccgucaagggccgcuucaccaucucccgcgacaacuccaagaacacccucuaccuccagaugaacucccuccgcgccgaggacaccgcccucuacuacugcgccaaggaccuccgcgaguucgagugcgaggagugggccuccgacuacuacgacuucggccgcgcccagcccugccaggacccccgcggcgucgucggcaccuucgaccucuggggccagggcaccauggucaccgucuccucc

SEQ ID NO: 17290 - RNA, 432 nt, Artificial Sequence
  derived and/or modified sequence opt2 from anti-HIV_cap256-059-168734_VR-Chain
cagguccagcucgucgaguccggcggcggcgucguccagcccggccgcucccuccgccucuccugcaccgccucccaguucuccuucuccuccuacggcaugcacuggguccgccaggcccccggcaagggccucgagugggucgccgccaucuccuucgccggcaccaagaaguacuacgucggcaccgucaagggccgcuucaccaucucccgcgacaacuccaagaacacccucuaccuccagaugaacucccuccgcgccgaggacaccgcccucuacuacugcgccaaggacaugcgcgaguacgagugcgaggagugggccuccgacuacuacgacuucggccgcgaguaccccugccaggacccccgcggcgucgucggcaccuucgacaucuggggccagggcaccauggucaccgucuccucc

SEQ ID NO: 17291 - RNA, 432 nt, Artificial Sequence
  derived and/or modified sequence opt2 from anti-HIV_cap256-059-155838_VR-Chain
cagguccagcucgucgaguccggcggcggcgucguccagcccggccgcucccuccgccucuccugcgccgucucccaguucaccuucuccaacuacggcaugcacuggguccgccaggcccccggcaagggccucgagugggucgccgccaucuccuucgccggcaccaagaaguccuacgccgccuccgucaagggccgcuucaccaucucccgcgacaacuccaagaacacccucuaccuccagaugaacucccuccgccccgaggacaccgcccucuacuacugcgccaaggacaugcgcggcuucgagugcgaggagugggccuccgacuacuacgacuucggccgcgagcagcccugccaggacccccgcggcgucgucggcaucuucgaccucuggggccagggcaccauggucuccgucuccucc

SEQ ID NO: 17292 - RNA, 432 nt, Artificial Sequence
  derived and/or modified sequence opt2 from anti-HIV_cap256-059-149799_VR-Chain
cagguccaccucgucgaguccggcggcggcgucguccagcccggccgcucccuccgccucuccugcgccgccucccaguucaccuucuccaacuacggcuuccacuggguccgccaggcccccggcaagggccucgagugggucgccgccaucuccuucgccggcgucaagaagcacuacgccgacuccgucaagggccgcuucaccaucucccgcgacaacuccaagaacacccucuaccuccagcucaacucccuccgcgccgaggacaccgcccucuacuacugcgccaaggaccuccgcgaguacgagugcgaggagugggccuccgacuacuacgacuucggccgcgacuuccccugccaggacccccgcggcgucgucggcaccuucgacaucuggggccagggcaccauggucaccgucuccucc

SEQ ID NO: 17293 - RNA, 432 nt, Artificial Sequence
  derived and/or modified sequence opt2 from anti-HIV_cap256-059-148168_VR-Chain
cagguccagcucgucgaguccggcggcggcgucguccagcccggccgcucccuccgccucuccugcaccgccucccaguucaccuucuccaacuacggcaugcacuggguccgccaggcccccggcaagggccucgagugggucgccggcaucuccuucgccgccaccaagaaguacuacuccgacuccgucaagggccgcuucaccaucucccgcgacaacuccaagaacgcccucuaccuccagaugaacucccuccgcgccgaggacaccgcccucuaccacugcgccaaggaccuccgcgaguacgagugcgaggagugggccuccgacuacuacgacuucggccgcgagcagcccugccaggacccccgcggcgucgucggcaccuucgacaucuggggccagggcaccauggucaccgucuccacc

SEQ ID NO: 17294 - RNA, 435 nt, Artificial Sequence
  derived and/or modified sequence opt2 from anti-HIV_cap256-059-144685_VR-Chain
cagguccaccucgucgaguccggcggcggcgucguccagcccggccgcucccuccgccucuccugcgccgccuccggcuucaccuucuccaacuucgccauggacuggguccgccaggcccccggcaagggccucgagugggucgccuucgucuccuccgacggcaacaacaagaacuacggcgacuccgucaagggccgcuucaccaucucccgcgacaacuccaagaacacccucuuccuccagaugaacucccuccgcgccgaggacaccgcccucuacuacugcgucaaggacgucggcgacuacaaguccgacgagugggccacccacuacuacuacgaccucuccaucgccgaccccauccaggacccccgcgccgucgucggcgccuucgacaucuggggccgcggcaccauggucgccgucuccucc

SEQ ID NO: 17295 - RNA, 432 nt, Artificial Sequence
  derived and/or modified sequence opt2 from anti-HIV_cap256-059-140017_VR-Chain
cagguccagcucgucgaguccggcggcggcgucguccagcccggccgcucccuccgccucuccugcgccgccucccaguucuccuucggcaacuucggcaugcacuggguccgccaggcccccggcaagggccucgagugggucgccggcaucuccuucgccggcaccaagaaguacuacgccgacuccgucaagggccgcuucaccaucucccgcgacaacuccaaguccgcccucuuccuccagaugaacucccuccgcgccgaggacaccgcccucuacuacugcgccaaggaccuccgcuacuacgagugcgaggagugggccuccgacuacuacgacuucggccgcgaccagcccugccaggacccccgcggcgucgucggcaccuucgacauguggggccagggcaccauggucaccgucuccucc

SEQ ID NO: 17296 - RNA, 432 nt, Artificial Sequence
  derived and/or modified sequence opt2 from anti-HIV_cap256-059-137547_VR-Chain
cagguccagcucgucgaguccggcggcggcgucguccagcccggccgcucccuccgccucuccugcgccgccucccaguucaccuucucccgcuacggcaugcacuggguccgccaggcccccggcaagggccucgagugggucgccgccaucuccuucgccggcaucaagaagaacuacgccgacuccgucaagggccgcuucaccaucucccgcgacaacuccaagaacacccucuaccuccagaugaacucccuccgcgccgaggacaccgcccucuacuacugcgcccgcgaccuccgcgaguucgagugcgaggagugggccuccgacuacuacgacuucggccgcgacuuccccugccaggacccccgcggcgucgucggcaucuucgacaucuggggccagggcaccauggucaccgucuccucc

SEQ ID NO: 17297 - RNA, 435 nt, Artificial Sequence
  derived and/or modified sequence opt2 from anti-HIV_cap256-059-131908_VR-Chain
cagguccagcucgucgaguccggcggcggcgucguccagcccggccgcucccuccgccucuccugcaccgccuccggcuucaccuucuccaacuacggcauccacuggguccgccaggcccccggcaagggccucgagugggucgccgccaucuccuacgagggcuccaucaaguacuacgucgacuccgucaagggccgcuucaccaucucccgcgacgacuccaagaacacccucuuccuccagaugaacucccuccgcaccgaggacaccgccgucuacuacugcacccgcgacguccgcgagugggagaccgaggagugggccaccaacuacuacuacgaccucuccaucgccuaccccauccgccacccccgcggcgucgucggcaucuucgacgucuggggccucggcacccgcgucaccgucuccucc

SEQ ID NO: 17298 - RNA, 432 nt, Artificial Sequence
  derived and/or modified sequence opt2 from anti-HIV_cap256-059-116006_VR-Chain
caggcccagcucgucgaguccggcggcggcgucguccagcccggccgcucccuccgccucuccugcgccgccucccaguucuccuucuccuccuacggcaugcacuggguccgccaggcccccggcaagggccucgagugggucgccuccaucuccuucgccggcgucaagaagaccaacgccgacuccgucaagggccgcuucaccaucucccgcgacaacuccaagaacacccuccaccuccagaugaacggccuccgcaacgacgacaccgcccucuacuacugcgcccgcgaccuccgcgacuucgagugcgaggagugggccuccgacuacuacgacuucggccgcgaguuccccugccaggacccccgcggcgucgucggcaccuucgacaucuggggccagggcaccaaggucaccgucuccucc

SEQ ID NO: 17299 - RNA, 411 nt, Artificial Sequence
  derived and/or modified sequence opt2 from anti-HIV_cap256-059-115783_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuacgccgacuccgucaagggccgcuucaccaucucccgcgacaacuccaagaacacccucuaccuccagaugaacucccuccgcgccgaggacaccgcccucuacuacugcgccaaggaccuccgcgagauggagugcgaggagugggccuccgacuacuacgacuucggccgcgaccuccccugccaggacccccgcggcgucgucggcacccucgacaucuggggccagggcaccauggucaccgucuccucc

SEQ ID NO: 17300 - RNA, 432 nt, Artificial Sequence
  derived and/or modified sequence opt2 from anti-HIV_cap256-059-114609_VR-Chain
cagguccagcucgucgaguccggcggcggcgucguccagcccggccgcucccuccgccucuccugcgccgccucccagcucaccuucuccaacuucggcaugcacuggguccgccaggcccccggcaagggccucgagugggucgccggcaucuccuucgccggcaccaagaaguacuacgccgacuccgucaagggccgcuucaccaucucccgcgacaacuccaagaacgcccucuaccuccagaugaacacccuccgcgccgaggacaccgcccucuacuucugcgccaaggaccuccgcgaguacgagugcgaggagugggccuccgacuacuacgacuucggccgcgaccagcccugccaggacccccgcggcgucgucggcaucuucgacaucuggggccagggcaccauggucaccgucuccucc

SEQ ID NO: 17301 - RNA, 432 nt, Artificial Sequence
  derived and/or modified sequence opt2 from anti-HIV_cap256-059-113952_VR-Chain
caggcccagcucgucgaguccggcggcggcgucguccagcccggccgcucccuccgccucuccugcgccgccucccacuucaccuucuccuccuacggcuuccacuggguccgccaggcccccggcaagggccucgagugggucgccggcaucuccuucgccgccaccaagaaguacuacgccgacuccgucaagggccgcuucaccaucucccgcgacaacuccaaggacgcccucuaccuccagaugaacucccuccgcgccgaggacaccgcccucuacuacugcgcccgcgaccuccgcggcuacgagugcgaggagugggccuccgacuacuacgacuucggccgcgaccagcccugccaggacccccgcggcgucgucggcaucuucgaccucuggggccagggcaccauggucaccgucuccucc

SEQ ID NO: 17302 - RNA, 432 nt, Artificial Sequence
  derived and/or modified sequence opt2 from anti-HIV_cap256-059-113878_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacgccaccaacaaguacuacgucgacuccgucaagggccgcuucaccaucucccgcgacaacuccaagaacacccucuaccuccagauguccucccucaccgccgaggacaccgccgucuacuacugcgccaaggaccucggcggcaucaagaucgacgaguggggcaccgacuacuacgacaucuccgucuccuaccccguccaggacccccgcgccgucgccggcaucuucgacgucuggggccacggcaccauggucuccgucuccucc

SEQ ID NO: 17303 - RNA, 432 nt, Artificial Sequence
  derived and/or modified sequence opt2 from anti-HIV_cap256-059-113622_VR-Chain
cagguccagcucgucgaguccggcggcggcgucguccagcccggccgcucccuccgccucuccugcgccgccucccaguucaccuucaccuccuacggcaugcacuggguccgccaggcccccggcaagggccucgagugggucgccggcaucuccuucgccggcaccaagaagcacuacgccgacuccgucaagggccgcuucaccaucucccgcgacaacuccaaguccacccucuaccuccagaugaacucccuccgcgccgaggacaccgcccucuacuacugcgccaaggacaugcgcgaguacgagugcgaggagugggccuccgacuacuacgacuucggccgcgaccagcccugccaggacccccgcggcgucgucggcaucuucgaccucuggggccagggcaccauggucaccgucuccucc

SEQ ID NO: 17304 - RNA, 432 nt, Artificial Sequence
  derived and/or modified sequence opt2 from anti-HIV_cap256-059-109427_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccuccaucuccuucgccggcaucaagaagcacuacaccgacuccgucaagggccgcuucaccaucucccgcgacaacuccaagaacacccucuuccuccagaugaacucccuccgcgccgaggacaccgcccucuacuacugcgcccgcgaccuccgcgaguacgagugcgaggagugggccuccgacuacuacgacuucggccgcgaccagcccugccaggacccccgcggcgucgucggcaccuccgacaucuggggccagggcaccaaggucaccgucuccucc

SEQ ID NO: 17305 - RNA, 432 nt, Artificial Sequence
  derived and/or modified sequence opt2 from anti-HIV_cap256-059-109081_VR-Chain
caggagcagcucgucgaguccggcggcggcgucguccagcccggccgcucccuccgccucuccugcgccgccucccaguucuccuucuccgccuacggcaugcacuggguccgccaggcccccggcaagggccucgagugggucgccggcaucuccuucgccgccaccaagaaguacuacgaggacuccgucaagggccgcuucaccaucucccgcgacaacuccaagaacacccucuaccuccagaugaacucccuccgcggcgaggacaccgcccucuacuacugcgccaaggacaugcgcgagauggagugcgaggagugggccuccgacuacuacgacuucggccgcccccagcccugccaggacccccgcggcgucgucggcaucuucgacauguggggccagggcaccauggucaccgucuccucc

SEQ ID NO: 17306 - RNA, 432 nt, Artificial Sequence
  derived and/or modified sequence opt2 from anti-HIV_cap256-059-107590_VR-Chain
caggagcagcucgucgaguccggcggcggcgucguccagcccggccgcucccuccgccucuccugcgccgccucccaguucuccaucuccgccuacggcaugcacuggguccgccaggcccccggcaagggccucgagugggucgccggcaucuccuucgccggcaccaagaaguacuacgccgacuccgucaagggccgcuucaccaucucccgcgacaacuccaagaacacccucuaccuccagaugaacucccuccgcggcgaggacaccgcccucuacuacugcgccaaggacaugcgcgagauggagugcgaggagugggccuccgacuacuacgacuucggccgcgaccagcccugccaggacccccgcggcgucgucggcaucuucgacauguggggccagggcaccauggucaccgucuccucc

SEQ ID NO: 17307 - RNA, 435 nt, Artificial Sequence
  derived and/or modified sequence opt2 from anti-HIV_cap256-059-107504_VR-Chain
cagguccuccucgucgaguccggcggcggcgucguccagcccggcaagucccuccgccucuccugcuccgccucccgcuucaccuucuccaacuacggcaugcacuggguccgccaggcccccggcaagggccucgagugggucgccgccgucuccuucgccggcaucaagaagaccaacgccgacuccgucaagggccgcuucaccaucucccgcgacaacuccaagaacacccucuaccuccagaugaacucccuccgcgccgaggacaccgcccucuacuacugcgcccgcgaccuccgcgacuucgagugcgaggagugggccuccgacuacuacgacuucuggggcgacccccagcccugccaggacccccgcggcgucgucggcaccuucgaccucuggggccagggcaccauggucaccgucuccucc

SEQ ID NO: 17308 - RNA, 432 nt, Artificial Sequence
  derived and/or modified sequence opt2 from anti-HIV_cap256-059-099614_VR-Chain
gagguccuccuccucgaguccggcggcggccucguccagcccggccgcucccuccgccucuccugcgccgccucccaguucaccuucuccuccuacggcaugcacuggguccgccaggcccccggcaagggccucgagugggucgccggcaucuccuucgucggcaucaagaaguacuacgccgacuccgucaagggccgcuucaccaucucccgcgacaacuccaagaacacccucuaccuccagaugaacucccuccgcgccgaggacaccgcccucuacuacugcgcccgcgaccuccgcgaguacgagugcgaggagugggccuccgacuacuacgacuucggccgcgaccagcccugccaggacccccgcggcgucgucggcaccuucgacaucuggggccagggcaccauggucaccgucuccucc

SEQ ID NO: 17309 - RNA, 432 nt, Artificial Sequence
  derived and/or modified sequence opt2 from anti-HIV_cap256-059-098972_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccuccaucuccuucgccggcaucaagaagaacuaccgcgacuccgucaagggccgcuucaccaucucccgcgacaacuccaagaacacccucuaccuccagaugaccucccuccgccccgaggacaccgcccucuacuacugcgccaaggaccuccgcggcuucgagugcgaggagugggccuccgacuacuacgacuucggccgcgagcuccccugccaggacccccgcggcgucgucggcaccuucgacauguggggccagggcaccauggucaccgucuccucc

SEQ ID NO: 17310 - RNA, 432 nt, Artificial Sequence
  derived and/or modified sequence opt2 from anti-HIV_cap256-059-097236_VR-Chain
cagguccagcucgucgaguccggcggcggcgucguccagcccggccgcucccuccgccucuccugcgccgccuccggcuucuccuucuccaacuucggcuuccacuggguccgccaggcccccggcaagggccucgagugggucgccgccaucuccuucgucggcaacaagaaguacuacgccgaguccgucaagggccgcuucaccaucucccgcgagaacuccaagaacaugcucuuccuccagaugaacucccuccgcggcgaggacaccgccgucuacuacugcgccaaggaccuccgcgaguucgagugcgaggagugggccuccgacuacuacgacuucggccgcgagcagcccugccaggacccccgcggcgucgucggcuccaucgacgucuggggccacggcucccucgucaccgucuccucc

SEQ ID NO: 17311 - RNA, 432 nt, Artificial Sequence
  derived and/or modified sequence opt2 from anti-HIV_cap256-059-091487_VR-Chain
cagguccagcucgucgaguccggcggcggcgucguccagcccggccgcucccuccgccucuccugcgccgccucccaguucaccuucaaccgcuacggcaugcacuggguccgccaggcccccggcaagggccucgagugggucgccgucaucuccuacgacggcaccaacaaguacuacggcgaguccgucaagggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggccgcgagcuccccugccgcaagucccgcggcgucgccggcaucuucgacaucuggggccagggcaccauggucaccgucuccucc

SEQ ID NO: 17312 - RNA, 432 nt, Artificial Sequence
  derived and/or modified sequence opt2 from anti-HIV_cap256-059-089812_VR-Chain
cagguccagcucgucgaguccggcggcggcgucguccagcccggccgcucccuccgccucuccugcgccgccucccagcucaccuucuccuccuacggcaugcacuggguccgccaggcccccggcaagggccucgagugggucgccggcaucuccuucgccggcaccaagaagcacuacuccgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgagcagcccugccaggacccccgcggcgucgucggcaucuucgacauguggggccagggcaccauggucaccgucuccucc

SEQ ID NO: 17313 - RNA, 432 nt, Artificial Sequence
  derived and/or modified sequence opt2 from anti-HIV_cap256-059-088468_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgucggcaucaagaaguacuacgccaacuccgucaagggccgcuucaccaucucccgcgacaacuccaagaacacccucuaccuccagaugaacucccuccgcgccgaggacaccgcccucuacuacugcgcccgcgaccuccgcgaguacgagugcgaggagugggccuccgacuacuacgacuucggccgcggcggccccugccaggacccccgcggcgucgucggcuccuucgacaucuggggccagggcaccauggucaccgucuccucc

SEQ ID NO: 17314 - RNA, 432 nt, Artificial Sequence
  derived and/or modified sequence opt2 from anti-HIV_cap256-059-088341_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgccggcaucaagaagcacuacgccgacuccgucaagggccgcuucaccaucucccgcgacaacuccaagaacauggucuuccuccagaugaacucccuccgcgccgaggacaccgcccucuacuacugcgcccgcgaccuccgcgaguacgagugcgaggagugggccuccgacuacuacgacuucggccgcgaccagcccugccaggacccccgcggcgucgucggcaccuccgacaucuggggccagggcaccauggucaccgucuccucc

SEQ ID NO: 17315 - RNA, 432 nt, Artificial Sequence
  derived and/or modified sequence opt2 from anti-HIV_cap256-059-086533_VR-Chain
cagguccuccucgucgaguccggcggcggcgucguccagcccggccgcucccuccgccucuccugcgccgccucccaguucaccuucuccaacuucggcaugcacuggguccgccaggcccccggcaagggccucgagugggucgccggcaucuccuucgucggcaucaagaaguacuacgccggcuccgucaagggccgcuucaccaucucccgcgacaacuccaagaacacccucuaccuccagaugaacucccuccgcgccgaggacaccgcccucuacuacugcgccaaggaccuccgcgaguucgagugcgaggagugggccuccgacuacuacgacuucggccgcccccagcccugccaggacccccgcggcgucgucggcaccuucgaccucuggggccucggcacccucgucaccgucuccucc

SEQ ID NO: 17316 - RNA, 432 nt, Artificial Sequence
  derived and/or modified sequence opt2 from anti-HIV_cap256-059-086043_VR-Chain
gagguccaccucgucgaguccggcggcggccucgucaagcccggcggcucccuccgccucuccugcgccgccuccggcuucaccuucuccaccuacuccaugaacuggguccgccaggcccccggcaagggccucgagugggucgccuucgucgccuucgacgaguccgacaaguacuacgccgacuccgucaagggccgcuucaccaucucccgcgacaacuccaagaacacccucucccuccagaugaacucccuccgcgucgaggacaccgccaucuacuacugcgccaaggaggucggcgacaacaaggacgacgagugggccuccgacuacuacgaccucuccaucgccuaccccauccaggacccccgcgccgucggccgcggcuacgacaucuggggccagggcaccauggucaccgucuccucc

SEQ ID NO: 17317 - RNA, 432 nt, Artificial Sequence
  derived and/or modified sequence opt2 from anti-HIV_cap256-059-084191_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgucggcaucaagaaguacuacgccgacuccgucaagggccgcuucaccgucucccgcgacaacuccaaguccacccucuaccuccagaugaacucccuccgcgccgaggacaccgcccucuacuacugcgcccgcgaccuccgcgaguacgagugcgaggagugggccuccgacuacuacgacuucggccgcgaccagcccugccaggacccccgcggcgucgucggcaucuucgacaucuggggccagggcaccgccgucaccgucuccucc

SEQ ID NO: 17318 - RNA, 417 nt, Artificial Sequence
  derived and/or modified sequence opt2 from anti-HIV_cap256-059-082135_VR-Chain
cagguccagcucgucgaguccggcggcggcgucguccagcccggccgcucccuccgccucuccugcaccgccuccggcuucaccuuccgcuccuacgccauccacuggguccgccaggcccccggcaagggccucgagugggucgcccucaucuccuacgacggcuccaacaaguacuacgccgacuccgucaagggccgcuucaccaucucccgcgacaacuccaagaacacccucuaccuccagaugaacucccucaccuccgaggacaccgccgucuacuacugcgccaaggaccucggcggcuccaagaccgacgaguggggcaccgacuacugcuaccccguccaggacccccgcgucgucgucggcgccuucgacaucuggggccacggcaccauggucaccgucuccucc

SEQ ID NO: 17319 - RNA, 432 nt, Artificial Sequence
  derived and/or modified sequence opt2 from anti-HIV_cap256-059-079417_VR-Chain
cagguccagcucgucgaguccggcggcggcgucguccagcccggccgcucccuccgccucuccugcgccgccuccggcuucuccuucuccaacuacgccauggacuggguccgccaggcccccggcaagggccucgagugggucgccuucgucuccuccgacggcaacaacaagaaguacgccgacuccgucaagggccgcuucacccucucccgcgacaacuacaagaacaccgucuaccuccagaugaacucccucaccgucgaggacaccgccgucuacuacugcgccaaggaccucggcgccaacaaggacgacgaguggggcaccgacuacuacgacauguccgucuccuaccccauccccgacccccgcgccgucgucggcgccuucgacgucuggggccagggcacccucgucaccgucuccucc

SEQ ID NO: 17320 - RNA, 435 nt, Artificial Sequence
  derived and/or modified sequence opt2 from anti-HIV_cap256-059-076027_VR-Chain
cagguccagcucgucgaguccggcggcggcgucguccagcccggccgcucccuccgccucuccugcgccgccuccggcuucuccuucuccaaguacggcaugcacuggguccgccaggcccccggcaagggccucgagugggucgccuucgucgccuucgacgaguccgagaaguacuacgccgccuccgucaagggccgcuucaccaucucccgcgacaacuccaagaacacccucucccuccagaugaacucccuccgcaccgaggacaccgccaucuacuacugcgccaaggaggucggcgacaacaaggacgacgaguggaccucccccuacuacuacgacaucuccaucgccuaccccguccacgacccccgcgccgucgucggcgucuccgacgucuggggccagggcaccauggucaccgucuccucc

SEQ ID NO: 17321 - RNA, 432 nt, Artificial Sequence
  derived and/or modified sequence opt2 from anti-HIV_cap256-059-075082_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgucggcaucaagaaguacuacgccgacuccgucaagggccgcuucaccaucucccgcgacaacuccaagaacacccucuaccuccagaugaacucccuccgcgccgaggacaccgcccucuacuacugcgccaaggaccuccgcgagauggagugcgaggagugggccuccgacuacuacgacuucggccgcgaccuccccugccaggacccccgcggcgucgucggcacccucgacaucuggggccagggcaccauggucaccgucuccucc

SEQ ID NO: 17322 - RNA, 432 nt, Artificial Sequence
  derived and/or modified sequence opt2 from anti-HIV_cap256-059-072575_VR-Chain
cagggccagcucgucgaguccggcggcggcgucguccagcccggccgcucccuccgccucuccugcgccgccucccaguucaccuucuccaacuucggcaugcacuggguccgccaggcccccggcaagggccucgagugggucgccgucaucuccuacgacggcaccaagaaguacuacgccgacuccgucaagggccgcuucaccaucucccgcgacaacuccaagaacacccucuaccuccagaugaacucccuccgcgccgaggacaccgcccucuacuacugcgccaaggacaugcgcgaggacgagugcgaggaguggggcgccgacuacuacgacuucggcaaggacuaccccugccaggccucccgcggcgucgucggcaucuucgacaucuggggccagggcaccauggucaccgucuccgcc

SEQ ID NO: 17323 - RNA, 432 nt, Artificial Sequence
  derived and/or modified sequence opt2 from anti-HIV_cap256-059-071926_VR-Chain
cagguccagcucgucgaguccggcggcggcgucguccagcccggccgcucccuccgccucuccugcgccgccucccagcucuccuucuccaacuacggcaugcacuggguccgccaggcccccggcaagggccucgagugggucgccggcaucuccuucgucggcaucaagaaguacuaccgcgacuccgucaagggccgcuucaccaucucccgcgacaacuccaagaacacccucuaccuccagaugaacucccuccgcaccgaggacaccgcccucuacuacugcgucaaggaccuccgcgaguucgagugcgaggagugggccuccgacuacuacgacuucggccgcgaccagcccugccucgacccccgcggcgucgucggcaccuucgacaucuggggccagggcaccauggucaccgucuccucc

SEQ ID NO: 17324 - RNA, 432 nt, Artificial Sequence
  derived and/or modified sequence opt2 from anti-HIV_cap256-059-069638_VR-Chain
cagguccagcucgucgaguccggcggcggcgucguccagcccggccgcucccuccgccucuccugcgccgccuccggcuucaccuucuccaagaacgccaugcacuggguccgccaggcccccggccgcggccucgagugggucgccuccgucgccuucgacggcuccgacaaguacuacgccgacuccgucaagggccgcuucaccaucucccgcgacaacuccaagaacacccucucccuccagaugaacucccuccgcgccgaggacaccgccgucuacuacugcgccaaggaggucgaccucuacaaggacgacgaguggggcuccgacuacuacgaccucuccaucgccuaccccauccaggacccccgcgccgucgucggcggcuucggcaucuggggccagggcaccauggucaccgucuccucc

SEQ ID NO: 17325 - RNA, 432 nt, Artificial Sequence
  derived and/or modified sequence opt2 from anti-HIV_cap256-059-069165_VR-Chain
cucguccagcucgucgaguccggcggcggcgucguccagcccggccgcucccuccgccucuccugcgccgccucccgcuucaccuucuccaacuacggcaugcacuggguccgccaggcccccggcaagggccucgagugggucgccggcaucuccuucgccggcaccaccaaguacuacgccgacuccguccgcggccgcuucaccaucucccgcgacaacuccaagaacacccucuaccuccagaugaacucccuccgcgccgaggacaccgcccucuacuacugcgccaaggacaugcgcgagauggagugcgaggagugggccuccgacuacuacgacuucggccgcccccagcccugccaggacccccgcggcgucgucggcaucuucgacaucuggggccagggcaccauggucaccgucuccucc

SEQ ID NO: 17326 - RNA, 432 nt, Artificial Sequence
  derived and/or modified sequence opt2 from anti-HIV_cap256-059-068956_VR-Chain
cagguccagcucgucgaguccggcggcggcgucguccagcccggccgcucccuccgccucuccugcgccgccuccggcuucaccuucuccaccuacgccaugcacuggguccgccaggcccccggccgcggccucgagugggucgcccucaucuccuacgacggcuccaacaaguacuacgucgacuccgucaagggccgcuucaccaucucccgcgacaacuccaagaacacccucuaccuccagaugaacucccucaccgccgaggacaccgccgucuacuacugcgccaaggaccucggcggcuccaaggacgacgagugggccaccgacuacuacgaccucuccaucgccuaccccauccaggacccccgcgccgucgccggcaucuucgacgucuggggccgcggcaccgucgucaccgucuccucc

SEQ ID NO: 17327 - RNA, 432 nt, Artificial Sequence
  derived and/or modified sequence opt2 from anti-HIV_cap256-059-068876_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgccggcaccaagaaguacuacgccaacuccgucaagggccgcuucaccaucucccgcgacaacuccaagaacacccucucccuccagaugaacucccuccgcggcgaggacaccgcccgcuacuacugcgcccgcgacccccgcgaguacgagugcgaggagugggccuccgacuacuacgacuucggccgcgaccagcccugccaggacccccgcggcgucaucggcaucuucgacaucuggggccagggcaccauggucaccgucuccucc

SEQ ID NO: 17328 - RNA, 432 nt, Artificial Sequence
  derived and/or modified sequence opt2 from anti-HIV_cap256-059-067733_VR-Chain
cagguccagcucgucgaguccggcggcggcgucguccagcccggccgcucccuccgccucuccugcaccgccucccaguucuccuucuccuccuacggcaugcacuggguccgccaggcccccggcaagggccucgagugggucgccgccaucuccuucgccggcaccaagaagaacuacgucgacuccgucaagggccgcuucaccaucucccgcgacaacuccaagaacacccucuaccuccagaugaacucccuccgcgccgacgacaccgcccucuacuacugcgccaaggacaugcgcgaguacgagugcgaggagugggccuccgacuacuacgacuucggccgcgaguaccccugcaccgacccccgcggcgucgucggcaccuucgacgucuggggccagggcaccauggucaccgucuccucc

SEQ ID NO: 17329 - RNA, 432 nt, Artificial Sequence
  derived and/or modified sequence opt2 from anti-HIV_cap256-059-067450_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccggcaucuccuucgccggcaucaagaaguacuacgccgacuccgucaagggccgcuucaccaucucccgcgacaacgccaagaacacccucuaccuccagaugaacucccuccgcgccgaggacaccgcccucuacuacugcgccaaggaccuccgcgaguacgagugcgaggagugggccuccgacuacuacgacuucggccgcgagcuccccugccaggacccccgcggcgucgucggcaccuucgacaucuggggccagggcaccauggucaccgucuccucc

SEQ ID NO: 17330 - RNA, 432 nt, Artificial Sequence
  derived and/or modified sequence opt2 from anti-HIV_cap256-059-065694_VR-Chain
cagguccagcucgucgaguccggcggcggcgucguccagcccggccgcucccuccgccucuccugcgccgccucccagcucaccuucaacaacuacggcaugcacuggguccgccagacccccggcaagggccucgagugggucgccggcaucuccuucgccggcaucaacaaguacuacgccgacuccgucaagggccgcuucaccaucucccgcgacaacuccaagaacgcccucuaccuccagaugaccucccuccgcgccgaggacaccgcccucuacuacugcgucaaggaccuccgcgagauggagugcgaggagugggccuccgacuacuacgacuucggccgcgaccagcccugccaggacccccgcggcgucgucggcaccuucgacaucuggggccagggcaccauggucaccgucuccucc

SEQ ID NO: 17331 - RNA, 432 nt, Artificial Sequence
  derived and/or modified sequence opt2 from anti-HIV_cap256-059-065109_VR-Chain
cagguccagcucgucgaguccggcggcggcgucguccagcccggcaagucccuccgccucuccugcgccgccuccggcuucaccuucaccaacaacgccaugaacuggguccgccaggcccccggcaagggccucgagugggucgccuucgucuccuccgacggccgcaacaagaacuacgccgacuccgucaagggccgcuucaccaucucccgcgacaacuccaagaacaccgucuaccuccagaugaacucccuccgcgucgaggacaccgcccucuacuacugcgccaaggaccucggcgccaacaaggacgacgagugggccaccgacuacuacgaccucuccgucgccuaccccauccccgacccccgcgccgucgucggcgccuucgacgucuggggccagggcaccauggucaccgucuccucc

SEQ ID NO: 17332 - RNA, 432 nt, Artificial Sequence
  derived and/or modified sequence opt2 from anti-HIV_cap256-059-065060_VR-Chain
cagguccagcucgucgaguccggcggcggcgucguccagcccggcaccucccuccgccucuccugcgccgccuccggcuucaccuucuccaacuacgccaugggcuggguccgccaggcccccggcaagggccucgagugggucgccgucgucuccuacgacggcuccaagaaguccuacgccgacuccgucaagggccgcuucaccaucucccgcgacaacucccgcaacacccucuaccuccagcucaacucccuccgcgccgaggacaccgccauguucuacugcgccaaggaccucggcaagggcgagaucgaggagugggccaccgacuacuacgacugguccaaggccuaccccaucgagggcccccgcgacgucgucggcgccuucgacaccuggggccagggcacccucgucaccgucuccucc

SEQ ID NO: 17333 - RNA, 432 nt, Artificial Sequence
  derived and/or modified sequence opt2 from anti-HIV_cap256-059-064001_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccggcaucuccuucgccggcaccaagaacuacuacgccaaguccgucaagggccgcuucaccaucucccgcgacaacuccaagaacgcccucuaccuccagaugaacucccuccgcgccgaggacaccgcccucuacuacugcgccaaggacaugcgcgaguacgagugcgaggagugggccuccgacuacuacgacuucggccgcgaccagcccugccaggacccccgcggcgucgucggcaccuucgacaucuggggccagggcaccauggucgccgucuccucc

SEQ ID NO: 17334 - RNA, 432 nt, Artificial Sequence
  derived and/or modified sequence opt2 from anti-HIV_cap256-059-063270_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccgccaucuccuucgccggcaccaagaagcacuacgccgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgaccagcccugccucgacccccgcggcgucgucggcaucuucgacaucuggggccagggcacccucgucaccgucuccucc

SEQ ID NO: 17335 - RNA, 432 nt, Artificial Sequence
  derived and/or modified sequence opt2 from anti-HIV_cap256-059-061357_VR-Chain
cagguccagcucgucgaguccggcggcggcgucguccagcccggccgcucccuccgccucuccugcgccgccuccggcuucaccuucuccaacuucggcuuccacuggguccgccaggcccccggcaagggccucgagugggucgccggcaucuccuucgccggcaccaagaucuacuacgccgacuccgucaagggccgcuucaccaucucccgcgagaacuccaagaacaugcucuaccuccagaugaacucccuccgcggcgaggacaccgccgucuacuucugcgccaaggaccuccgcgaguucgagugcgaggagugggccuccgacuacuacgacuucggccgcgaguuccccugccaggacccccgcggcgucgucggcaccuucgacgucuggggccacggcgccgucgucaccgucuccucc

SEQ ID NO: 17336 - RNA, 435 nt, Artificial Sequence
  derived and/or modified sequence opt2 from anti-HIV_cap256-059-059834_VR-Chain
cagguccagcucgucgaguccggcggcggcgucguccagcccggccgcucccuccgccucuccugcgccgccuccggcuucaccuucuccaacuucggcaugcacuggguccgccaggcccccggcaagggccucgagugggucgccuucgucgccuucgacgaguccgacaaguacuacgccgccuccgucaagggccgcuucaccgucucccgcgacaacuccaagaacaccgucucccuccagaugaacucccuccgcaccgaggacaccgccgucuacuacugcgccaaggaggucggcgacaacaaggacgacgaguggaccucccccuacuacuacgacuucuccaucgccuaccccguccacgacccccgcgccgucgucggcggcuacgacgucuggggccagggcaccauggucaccgucuccucc

SEQ ID NO: 17337 - RNA, 432 nt, Artificial Sequence
  derived and/or modified sequence opt2 from anti-HIV_cap256-059-059313_VR-Chain
cagguccaccucgucgaguccggcggcggcgucguccagcccggcaagucccuccgccucuccugcgccgccucccaguucaccuucuccaacuucggcaugcacuggguccgccaggcccccggcaagggccucgagugggucgccggcaucuccuucgccggcaccaagaaguacuacgccgacuccgucaagggccgcuucaccaucucccgcgacaacuccaagaacacccucuaccuccagaugaacuccguccgcgccgaggacaccgcccucuacuacugcgccaaggacaugcgcgaguacgagugcgaggagugggccuccgacuacuacgacuucggcaagccccagcccugccaggacccccgcggcgucgucggcaccuucgacauguggggccucggcacccucgucaccgucuccucc

SEQ ID NO: 17338 - RNA, 432 nt, Artificial Sequence
  derived and/or modified sequence opt2 from anti-HIV_cap256-059-057130_VR-Chain
cagguccagcucgucgaguccggcggcggcgucguccagcccggccgcucccuccgccucuccugcgccgccucccaguucuccuucuccuccuacggcaugcacuggguccgccaggcccccggcaagggccucgagugggucgccgccaucuccuucgccggcaucaagaagcacuacgccgacuccgucaagggccgcuucaccaucucccgcgacaacuccaagaacacccucuaccuccagaugaacucccuccgcgucgaggacaccgcccucuacuacugcgccaaggaccuccgcgaguacgagugcgaggagugggccuccgacuacuacgacuucggccgcccccagcccugccaggacccccgcggcgucgucggcaccuccgacaucuggggccagggcaccauggucaccgucuccucc

SEQ ID NO: 17339 - RNA, 411 nt, Artificial Sequence
  derived and/or modified sequence opt2 from anti-HIV_cap256-059-050520_VR-Chain
cagguccagcucgucgaguccggcggcggcgucguccagcccggccgcucccuccgccucuccugcgccgccucccaguucaccuucaaccgcuacggcaugcacuggguccgccaggcccccggcaagggccucgagugggucgccgucaucuccuacgccgacuccgucaagggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggccgcgagcuccccugccgcaagucccgcggcgucgccggcaucuucgacaucuggggccagggcaccauggucaccgucuccucc

SEQ ID NO: 17340 - RNA, 432 nt, Artificial Sequence
  derived and/or modified sequence opt2 from anti-HIV_cap256-059-049839_VR-Chain
cagguccagcucgucgaguccggcggcggcgucguccagcccggccgcucccuccgccucuccugcgccgccuccggcuucuccuucuccaacuacgccauggacuggguccgccaggcccccggcaagggccucgagugggucgccgucgucuccuccgacggcaagaccaagaacuacgccgacuccgucaagggccgcuucaccaucucccgcgacaacuccaagaacaccgucuaccuccagaugaacucccuccgccccgaggacaccgccgucuacuacugcgccaaggaccucggcgccaacaaggacgacgaguggaccaccgacuacuacgacugguccgucgccuaccccguccccgacccccgcgccgucgucggcgccuucgacgucuggggccagggcaccauggucaccgucuccucc

SEQ ID NO: 17341 - RNA, 432 nt, Artificial Sequence
  derived and/or modified sequence opt2 from anti-HIV_cap256-059-048503_VR-Chain
cagguccagcucgucgaguccggcggcggcgucguccagcccggccgcucccuccgccucuccugcgccgccucccagcucuccuucuccaacuacggcaugcacuggguccgccaggcccccggcaagggccucgagugggucgccggcaccuccuucgccggcaccaagaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgaccagcccugccaggacccccgcggcgucgucggcaccuucgacaucuggggccagggcaccauggucaccgucuccgcc

SEQ ID NO: 17342 - RNA, 432 nt, Artificial Sequence
  derived and/or modified sequence opt2 from anti-HIV_cap256-059-045516_VR-Chain
cagguccagcucgucgaguccggcggcggcgucguccagcccggccgcucccuccgccucuccugcgccgccucccaguucaccuucuccggcuacggcaugcacuggguccgccaggcccccggcaagggccucgagugggucgccgccaucuccuucgccggcaacaagcgcuacuucgccgacuccgucaagggccgcuucaccaucucccgcgacaacuccaagaacacccucuuccuccagaugaacucccuccgcgccgaggacaccgcccucuacuacugcgcccgcgacaugcgcgaguacgagugcgaggagugggccuccgacuacuacgacuucggccgcccccagcccugccaggacccccgcggcgucgucggcgucuucgacaucuggggccagggcaccauggucaccgucuccucc

SEQ ID NO: 17343 - RNA, 432 nt, Artificial Sequence
  derived and/or modified sequence opt2 from anti-HIV_cap256-059-044188_VR-Chain
cagguccaccucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuucgccggcaccaacaaguacuacgccgacuccgucaagggccgcuucaccgucucccgcgacaacuccaagaacacccucuacguccagaugaacucccuccgcgccgaggacaccgcccucuacuacugcgcccgcgaccuccgcgaguacgagugcgaggagugggccuccgacuacuacgacuucggccgcgagcagcccugccaggacccccgcggcgucgucggcaucuucgacaucuggggccccggcaccauggucaccgucuccucc

SEQ ID NO: 17344 - RNA, 435 nt, Artificial Sequence
  derived and/or modified sequence opt2 from anti-HIV_cap256-059-044105_VR-Chain
cagggccagcucgucgaguccggcggcggcgucguccagcccggccgcucccucucccucuccugcgccgccuccggcuucuccuucaacaacuacgccauggacuggguccgccaggcccccggcaagggccucgagugggucgccgucgucuccuccgacggcaacaacaagaacuacgccgacuccgucaagggccgcuucaccaucucccgcgacaacuccaagaacaccgucuaccuccagaugaacucccuccgcgccgaggacaccgccaucuacuacugcgccaaggacgucggcgccaacaaggacgacgagugggccaccaacuacuacuacgacugguccgucgccuaccccguccccgacccccgcgccgucaucggcgccuucgacgucuggggccagggcaccauggucaccgucuccucc

SEQ ID NO: 17345 - RNA, 432 nt, Artificial Sequence
  derived and/or modified sequence opt2 from anti-HIV_cap256-059-042100_VR-Chain
cagguccagcucgucgaguccggcggcggcgucguccagcccggccgcucccagcgccucuccugcgccgccucccaguucaccuucuccuccuacggcaugcacuggguccgccaggcccccggcaagggccucgagugggucgccgccaucuccuucgccggcaccaacaaguacuacggcgacuccgucaagggccgcuucaccaucucccgcgacaacuccaagaacacccucuaccuccagaugaacucccuccgcgccgaggacaccgcccucuaccacugcgcccgcgacaugcgcgaguacgagugcgaggagugggccuccgacuacuacgacuucggccgcgaccagcccugccaggacccccgcggcgucgucggcaucuucgaccucuggggccagggcaccauggucaccgucuccucc

SEQ ID NO: 17346 - RNA, 432 nt, Artificial Sequence
  derived and/or modified sequence opt2 from anti-HIV_cap256-059-040742_VR-Chain
cagguccagcucgucgagaccggcggcggcgucggccagcccggcaagucccuccgccucuccugcgccgccuccggcuucaccuucuccaacuucgccauggacuggguccgccaggcccccggcaagggccucgagugggucgccuucaucuccuccgacggcaucaacaagaaguacggcgacuucgucaagggccgcuucaccaucucccgcgacaacuccaagaacacccucuuccuccagaugaacucccuccgcgccgaggacaccgcccucuacuacugcgccaaggacgucggcgacuacaaguccgacgaguggggcaccgacuacuacgaccucuccaucgaguaccccauccaggacccccgcgccgucgucggcgccuucgacaacuggggccagggcaccauggucaucgucuccucc

SEQ ID NO: 17347 - RNA, 432 nt, Artificial Sequence
  derived and/or modified sequence opt2 from anti-HIV_cap256-059-040554_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuucgccgccaccaacaaguacuacggcggcuccgucaagggccgcuucaccaucucccgcgacaacuccaagaacacccucuaccuccagaugaacucccuccgcgccgaggacaccgcccucuacuacugcacccgcgacaugcgcgaguacgagugcgaggagugggccuccgacuacuacgacuucggcaaggaccagcccugccaggacccccgcggcgucgucggcacccucgacaucuggggccagggcaccauggucaccgucuccucc

SEQ ID NO: 17348 - RNA, 432 nt, Artificial Sequence
  derived and/or modified sequence opt2 from anti-HIV_cap256-059-039660_VR-Chain
cagguccagcucgucgaguccggcggcggcgucguccagcccggccgcucccuccgccucuccugcgccgccucccaguucuccuucuccaacuacggcaugcacuggguccgccaggcccccggcaagggccucgagugggucgccuccaucuccuucgccggcaccaagaagaaguacgccgacuccgucaagggccgcuucaccaucucccgcgacaacuccaagaacacccucuuccuccagaugaacucccuccgcaccgaggacgccgcccucuacuacugcgccaaggacaugcgcgaguucgagugcgaggagugggccuccgacuacuacgacuucggccgcgagcagcccugccaggacacccgcgacgucgucggcaucuucgacaucuggggccagggcaccauggucaccgucuccucc

SEQ ID NO: 17349 - RNA, 435 nt, Artificial Sequence
  derived and/or modified sequence opt2 from anti-HIV_cap256-059-039298_VR-Chain
cagguccagcucgucgaguccggcggcggcgucguccagcccggccgcucccuccgccucuccugcgccgccuccggcuucaccuucuccaaguacggcaugcacuggguccgccaggcccccggcaagggccucgagugggucgccuucgucgccuucgacgaguccgacaaguacuacgccgccuccgccaagggccgcuucaucaucucccgcgacaacuccaagaacacccucucccuccagaugaacucccuccgcaccgaggacaccgccgucuacuacugcgccaaggaggucggcgacaacaaggacgacgaguggaccucccccuacuacuacgacaucuccaucgccuaccccguccaggacccccgcgccgucgucggcggcuacgacgucuggggccagggcaccauggucaccgucuccucc

SEQ ID NO: 17350 - RNA, 432 nt, Artificial Sequence
  derived and/or modified sequence opt2 from anti-HIV_cap256-059-037873_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccgccaucuccuucgccggcaucaacaaguacuacgccgacuccgucaagggccgcuucacccucucccgcgacaacaccaagaacacccucuaccuccagaugaacucccuccgcgccgaggacaccgcccucuacuacugcgcccgcgaccuccgcgaguacgagugcgaggagugggccuccgacuacuacgacuucggccgcccccagcccugccaggacccccgcggcgucgucggcaccuccgacaucuggggccagggcaccauggucaccgucuccucc

SEQ ID NO: 17351 - RNA, 432 nt, Artificial Sequence
  derived and/or modified sequence opt2 from anti-HIV_cap256-059-037633_VR-Chain
cagguccagcucgucgaguccggcggcggcgucguccagcccggccgcucccuccgccucuccugcgccgccucccaguucaccuucuccaacuucggcaugcacuggguccgccaggcccccggcaagggccucgagugggucgccgccaucuccuucgccggcaucaacaagaacuacgccgacuccgucaagggccgcuucaccaucucccgcgacaacuccaagaacacccuccaccuccagcucaacucccuccgcgccgaggacaccgcccucuacuacugcgccaaggaccuccgcgaguacgagugcgaggagugggccuccgacuacuacgacuucggccgcgaccagcccugccaggacccccgcggcgucgucggcaccuucgacaucuggggccagggcaccauggucaccgucuccucc

SEQ ID NO: 17352 - RNA, 432 nt, Artificial Sequence
  derived and/or modified sequence opt2 from anti-HIV_cap256-059-036817_VR-Chain
cagguccagcuccucgaguccggcggcggcgucguccagcccggccgcucccuccgccucuccugcgaggccucccaguucaccuucuccaacuucggcaugcacuggguccgccaggcccccggcaagggccucgagugggucgccgccaucuccuucgccggcaucaagaagaacuacgccgacuccgucaagggccgcuucaccaucucccgcgacaacuccaagaacacccucuaccuccagaugaacucccuccgcgucgaggacaccgcccucuacuacugcgccaaggaccuccgcgaguacgagugcgaggagugggccuccgacuacuacgacuucggccgcgagcagcccugccaggacccccgcggcgucaucggcaccuucgacaucuggggccagggcaccauggucaccgucuccucc

SEQ ID NO: 17353 - RNA, 432 nt, Artificial Sequence
  derived and/or modified sequence opt2 from anti-HIV_cap256-059-032787_VR-Chain
cagguccagcucgucgaguccggcggcggcgucguccagcccggccgcucccuccgccucuccugcgccgccuccggcuucaccuucuccaaguacgccaugcacuggguccgccaggcccccggcaagggccucgagugggucgccuucgucgccuucgacgaguccgacaaguacuacgucgacuccgucaagggccgcuucaccaucucccgcgacaacuccaagaacacccucucccuccagaugaacucccuccgcgccgaggacaccgccgucuacuacugcgccaaggagguccacgucaacaaggacgacgagugggccuccgacuacuacgaccucuccaucgccuaccccauccaggacccccgcgccgucgucggcggccucgacaucuggggccagggcaccauggucaccgucuccucc

SEQ ID NO: 17354 - RNA, 432 nt, Artificial Sequence
  derived and/or modified sequence opt2 from anti-HIV_cap256-059-032427_VR-Chain
cagguccagcucgucgaguccggcggcggcgucguccagcccggccgcucccuccgccucuccugcgccgccucccaguucaccuucuccaacuucggcaugcacuggguccgccaggcccccggcaagggccucgagugggucgccggcaucuccuuccccggcaccaagaaguacuacgccgacuccgucaagggccgcuucaccaucucccgcgacaacuccaagaacgcccucuaccuccagaugaacucccuccgcgccgaggacaccgcccucuacuacugcgcccgcgaccuccgcgaguacgagugcgaggagugggccuccgacuacuacgacuucggcaagccccagcccugccucgacccccgcggcgucgucggcaccuucgacaucuggggccagggcaccauggucaccgucuccucc

SEQ ID NO: 17355 - RNA, 435 nt, Artificial Sequence
  derived and/or modified sequence opt2 from anti-HIV_cap256-059-029390_VR-Chain
cagguccagcucgucgaguccggcggcggcgucguccagcccggccgcucccuccgccucuccugcgccgccuccggcuucaccuucaaccagcacggcaugcacuggguccgccaggcccccgacaagggccucgagugggucgccuucgucggcuucgacgaguccgagaaguacuacgccgacuccgucaagggccgcuucaccaucucccgcgacaacuccaagaacacccucucccuccagaugaacucccuccgccccgaggacaccgccgucuacuacugcgccaaggaggucggcgacaacaaggaggacgagugggccuccgacuacuacuacgaccucuccaacgccuaccccauccacgacccccgcgccgucgucggcggcuacgacaucuggggccagggcaccauggucaccgucugcucc

SEQ ID NO: 17356 - RNA, 435 nt, Artificial Sequence
  derived and/or modified sequence opt2 from anti-HIV_cap256-059-027877_VR-Chain
cagguccagcucgucgaguccggcggcggcgucguccagcccggccgcucccuccgccucuccugcuccgccuccgccuucuccuucuccuacuucgccauggacuggguccgccaggcccccggcaagggccucgagugggucgccuucgucuccuccgacggcaacaacaagaacuacgccgacuccgucaagggccgcuucaccaucucccgcgacaacuccaagaacaccgucuuccuccagauggacucccuccgccccgaggacaccgccgucuacuacugcgccaaggaccucggcggcaacaaggacgacgagugguccaccaacuacuacuacgacaucuccaucgccgaccccguccccgacccccgcgccgucgccggcgccuucgacgucuggggccagggcaccauggucaccgucuccucc

SEQ ID NO: 17357 - RNA, 435 nt, Artificial Sequence
  derived and/or modified sequence opt2 from anti-HIV_cap256-059-026640_VR-Chain
cagguccagcucgucgaguccggcggcggcgucguccagcccggccgcucccuccgccucuccugcgccgccuccggcuucuccuucuccaaguacggcaugcacuggguccgccaggcccccggcaagggccucgagugggucgccuucgucgccuucgacgaguccgaccgcuacuacgccgccuccgucaagggccgcuucaccaucucccgcgacaacuccaagaacacccucucccuccagaugaacucccuccgcaccgaggacaccgccaucuacuacugcgccaaggaggucggcgacaacaaggacgacgaguggaccucccccuacuacuacgacauguccaucgccuaccccguccaggacccccgcgccgucgucggcggcuacgacaucuggggccagggcaccauggucaccgucuccucc

SEQ ID NO: 17358 - RNA, 432 nt, Artificial Sequence
  derived and/or modified sequence opt2 from anti-HIV_cap256-059-026017_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacggcaccaacaaguacuacgucgacuccgccaagggccgcuucaccaucucccgcgacaacuccaagaacacccucuaccuccagaugaacucccucacccccgaggacaccgccgucuucuacugcgccaaggaccucggcggcuacaaggacgacgaguggggcaccgaguacuacgacaucuccgucuccuaccccguccaggacccccgcgccgucgccggcgucuucgacgucuggggccacggcaccauggucaccgucuccucc

SEQ ID NO: 17359 - RNA, 432 nt, Artificial Sequence
  derived and/or modified sequence opt2 from anti-HIV_cap256-059-024100_VR-Chain
ugccagguccucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgccggcaccaagaaguacuacgccgacuccgucaagggccgcuucgccaucucccgcgacaccuccaagaacgcccucuaccuccagaugaacacccuccgcgccgaggacaccgcccucuacuacugcgcccgcgaccuccgcgaguucgagugcgaggagugggccuccgacuacuacgacuucggccgcccccagcccugccaggacccccgcggcgucgucggcuccuucgacaucuggggccagggcaccauggucaccgucucccuc

SEQ ID NO: 17360 - RNA, 432 nt, Artificial Sequence
  derived and/or modified sequence opt2 from anti-HIV_cap256-059-023966_VR-Chain
cagguccagcucgucgaguccggcggcggcgucguccagcccggccgcucccuccgccucuccugcgccgccucccaguucuccuucuccuccuacggcaugcacuggguccgccaggcccccggcaagggccucgagugggucgccgccaucuccuucgccggcaucaagaagcacuacaccgacuccgucaagggccgcuucaccaucucccgcgacaacuccaagaacacccucuaccuccagaugaacucccuccgcgccgaggacaccgcccucuacuacugcgccaaggaccuccgcggcuucgagugcgaggagugggccuccgacuacuacgacuucggccgcgaccagcccugccaggacccccgcggcgucgucggcaccuucgacaucuggggccagggcacccucgucaccgucuccucc

SEQ ID NO: 17361 - RNA, 432 nt, Artificial Sequence
  derived and/or modified sequence opt2 from anti-HIV_cap256-059-020534_VR-Chain
cagguccagcucgucgaguccggcggcggcgucguccagcccggccgcucccuccgccucuccugcgccgccucccaguucaccuucuccaacuacggcaugcacuggguccgccaggcccccggcaagggccucgagugggucgccggcauguccuucgccggcaccaacaccuacuacgccgacuccgucaagggccgcuucaccaucucccgcgacaacuccaagaacacccucuaccuccagaugaacucccuccgcgccgucgacaccgcccucuacuacugcgcccgcgacaugcgcgaguacgagugcgaggagugggccuccgacuacuacgacuucggccgcgaguaccccugccaggacccccgcggcgucgucggcaucuucgaccucuggggccagggcaccauggucaccgucuccucc

SEQ ID NO: 17362 - RNA, 435 nt, Artificial Sequence
  derived and/or modified sequence opt2 from anti-HIV_cap256-059-019513_VR-Chain
cagguccagcucgucgaguccggcggcggcgucguccagcccggccgcucccuccgccucuccugcgccgccuccggcuucaccuucuccaacuucgccaugggcuggguccgccaggcccccggcaagggccucgagugggucgccgucaucuccuccgacggcaccaacaagaacuacggcgacuccgucaagggccgcuucaccaucucccgcgacaacuccaagaacacccucuuccuccagaugaacucccuccgcgccgaggacaccucccucuacuacugcgccaaggaccucggcggcuacaagaccgacgagugggccaccaacuacuacuacgacaucuccaucgccucccccauccaggacccccgcgccgucgucggcgccuucgacaucuggggccagggcaccauggucaccgucaccucc

SEQ ID NO: 17363 - RNA, 432 nt, Artificial Sequence
  derived and/or modified sequence opt2 from anti-HIV_cap256-059-012963_VR-Chain
cagguccagcucgucgaguccggcggcggcgucguccagcccggccgcucccuccgccucuccugcgucgccuccggcuucuccuucuccuccuacggcauggccuggguccgccaggcccccggcaagggccucgagugggucaccgucaucuccuucgccggcgucaagaccuacuacgccgacuccgucaagggccgcuucaccaucucccgcgacaacuccaagggcacccucuaccuccagauggacggccuccgccccgaggacaccgcccucuacuacugcgccaaggaccucgccgagcgcgagugcgaggagugggccuccgacuacuacgacuucggccgcgagcuccccugccaggacccccgcggcgucgucggcaccuucgacgucuggggccagggcaccauggucaccgucuccucc

SEQ ID NO: 17364 - RNA, 435 nt, Artificial Sequence
  derived and/or modified sequence opt2 from anti-HIV_cap256-059-010396_VR-Chain
cagguccagcucgucgaguccggcggcggcgucguccagcccggccgcucccuccgccucuccugcgccgccuccggcuucuccuucaacaacuacgccaugaacuggguccgccaggcccccggcaagggccucgagugggucgccuucgucuccuccgacggcuccaacaagaacuacgccgacuccgucaccggccgcuucacccucucccgcgacaacuccaagaacaccgucuuccuccagaugaacucccuccgcgucgaggacaccgccgucuacuacugcgccaaggacgucggcgccaacaaggacgacgaguggaccaccaacuacuacuacgacaucuccaucgccgaccccguccccgacccccgcgccgucaucggcgccuucgacgucuggggccagggcaccauggucaccgucuccucc

SEQ ID NO: 17365 - RNA, 432 nt, Artificial Sequence
  derived and/or modified sequence opt2 from anti-HIV_cap256-059-008136_VR-Chain
cagguccagcucgucgaguccggcggcggcgucguccagcccggccgcucccuccgccucuccugcgccgccuccggcuucaccuucaacaccuacgccaugcacuggguccgccaggcccccggcaagggccucgagugggucgcccucaucuccuacgacggcaccgagaaguacuacgccgacuccgucaagggccgcuucaccaucucccgcgacaacucccgcaacacccucuaccuccagaugaacucccuccgccucgaggacgccgcccucuaccagugcgccaaggaccucggcggcuccaaguccgacgaguggggcaccgacuacuacgacauguccaucuccuaccccauccaggacccccgcgccgucgccggcgucuucgacaucuggggccagggcacccucgucaccgucuccucc

SEQ ID NO: 17366 - RNA, 432 nt, Artificial Sequence
  derived and/or modified sequence opt2 from anti-HIV_cap256-059-006147_VR-Chain
cagguccaggucgucgaguccggcggcggcgucguccagcccggccgcucccuccgccucuccugcaccgccuccggcuucaccuucuccaacuucgccaugggcuggguccgccaggcccccggcaagggccucgagugggucgccuucaucuccuccgacggcuccaacaagaacuacggcgacuccgucaagggccgcuucaccaucucccgcgacaacuccaagaacaccgucuuccuccagaugaacucccuccgcgucgaggacaccgcccucuacuacugcgccaaggacgucggcgacuacaaguccgacgaguggggcaccgaguacuacgacaucuccaucuccuaccccauccaggacccccgcgccauggucggcgccuucgaccucuggggccagggcaccauggucaccgucuccccc

SEQ ID NO: 17367 - RNA, 432 nt, Artificial Sequence
  derived and/or modified sequence opt2 from anti-HIV_cap256-059-005081_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuucgccgccaccaagaaguacuacuccgaguccgucaagggccgcuucaccaucucccgcgacaacuccaagaacgcccuccaccuccacaugaacucccuccgcgccgaggacaccgcccucuacuacugcgccaaggaccuccgcgaguucgagugcgaggagugggccuccgacuacuacgacuucggccgcgaccagcccugccaggacccccgcggcgucgucggcaucuucgacauguggggccagggcaccauggucaccgucuccucc

SEQ ID NO: 17368 - RNA, 432 nt, Artificial Sequence
  derived and/or modified sequence opt2 from anti-HIV_cap256-059-005006_VR-Chain
caggcccagcucgucgaguccggcggcggcgucguccagcccgccaagucccuccgccucuccugcgccgccuccggcuucaccuucaacaaguacgccaugcacuggguccgccaggcccccggcaagggccucgagugggucgccuucgucgccuucgacgaguccgacaaguacuacgccgacuccgucaagggccgcuucaccaucucccgcgacaacuccaagaacacccucucccuccagaugaacaaccuccgcgccgaggacaccgccgucuacuacugcgccaaggaggucggcgacaacaaggacgacgagugggccuccgacuacuacgaccucuccaucgccuaccccauccaggacccccgcgccgucggccgcggcuacgacaucuggggccagggcaccauggucaccgucuccucc

SEQ ID NO: 17369 - RNA, 432 nt, Artificial Sequence
  derived and/or modified sequence opt2 from anti-HIV_cap256-059-004451_VR-Chain
cagguccaccucgucgaguccggcggcggcgucguccagcccggcaagucccuccgccucuccugcaccgccuccggcuucaccuucaccaacuucgccauggacuggguccgccaggcccccggcaagggccucgagugggucgccuucaucuccuccgacggcuccaacaaguacuacuccgaguccgucaagggccgcuucaccaucucccgcgacaacuccaagaacacccucuacguccagaugaacucccuccgcaccgaggacaccgccgucuacuacugcgccaaggaccucggcggcuacaaggacgacgagugguccaccgacuacuacgacugguccaccgccuaccccguccaggacccccgcgccgucgccggcgccuucgaccucuggggccagggcaccauggucuccgucuccucc

SEQ ID NO: 17370 - RNA, 432 nt, Artificial Sequence
  derived and/or modified sequence opt2 from anti-HIV_cap256-059-003571_VR-Chain
caggagcagcucgucgaguccggcggcggcgucguccagcccggccgcucccuccgccucuccugcgccgccucccaguucaccuucggcgccuacggcaugcacuggguccgccaggcccccggcaagggccucgagugggucgccggcgucuccuucgucggcaacaacaaguacuacgccgacuccgucaagggccgcuucaccaucucccgcgacaacuccaagaacacccucuaccuccagaugaacucccuccgcggcgaggacaccgcccucuacuacugcgcccgcgacaugcgcgagauggagugcgaggagugggccuccgacuacuacgacuucggccgcccccagcccugccaggacccccgcggcgucgucggcaucuucgacauguggggccagggcaccauggucaccgucuccucc

SEQ ID NO: 17371 - RNA, 432 nt, Artificial Sequence
  derived and/or modified sequence opt2 from anti-HIV_cap256-059-003449_VR-Chain
cagguccagcucgucgaguccggcggcggcgucguccagcccggcaagucccuccgccucuccugcgccgccucccaggucaccuucuccuccuacggcaugcacuggguccgccaggcccccggcaagggccucgagugggucgccggcaucuccuucgccggcaccaagaaguacuacgccgacuccgucaagggccgcuucaccaucucccgcgacaacuccaagaacgcccucuaccuccagaugaaccgccuccgcgccggcgacaccgcccucuacuacugcgccaaggaccuccgcgaguacgagugcgaggagugggccuccgacuacuacgacuucggccgcgagcagcccugccaggacccccgcggcgucgucggcaucuucgacaucuggggccucggcaccauggucaccgucuccucc

SEQ ID NO: 17372 - RNA, 432 nt, Artificial Sequence
  derived and/or modified sequence opt2 from anti-HIV_cap256-059-002712_VR-Chain
cagguccagcucgccgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgccggcaccaagaagcacuacgccgacuccgucaagggccgcuucaccaucucccgcgacaacuccaagaacacccucaaccuccagaugaacucccuccgcgccgaggacaccgcccucuacuacugcgcccgcgacaugcgcgaguacgagugcgaggucugggccuccgacuacuacgacuucggccgcgagcagcccugccaggacccccgcggcgucgucggcaccuucgacaucuggggccagggcaccauggucaccgucuccccc

SEQ ID NO: 17373 - RNA, 432 nt, Artificial Sequence
  derived and/or modified sequence opt2 from anti-HIV_cap256-059-001573_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuacgacggcaccuccaaguacuacgccgacuccgucaagggccgcuucaccaucucccgcgacaacuccaagaacacccucuaccuccagaugaacucccuccgcgccgaggacaccgcccucuacuacugcgccaaggaccuccgcgaggacgagugcgaggaguggugguccgacuacuacgacuucggccgcgagcuccccugccgcaagucccgcggcgucgccggcaccuucgacaucuggggccacggcaccauggucaccgucuccucc

SEQ ID NO: 17374 - RNA, 432 nt, Artificial Sequence
  derived and/or modified sequence opt2 from anti-HIV_cap256-059-001379_VR-Chain
cagguccgccucgucgaguccggcggcggcgucguccagcccggccgcucccuccgccucuccugcgccgccuccggcuucaccuucaacuccuaccccaugcacuggguccgccaggcccccggcaagggccucgacugggucgcccucaucuccuacgacggcaccaacaaguucuacgucgacuccgucaagggccgcuucaccaucucccgcgacaacuccaagaacacccucuaccuccagaugaacucccucaccgccgaggacaccgccauguacuacugcgccaaggaccucggcggcaacaaggacgacgaguggggcaccgacuacuacgacaucuccgucgccuaccccauccacgacccccgcgccgucgccggcaucuucgacgucuggggccacggcaccauggucaccgucuccucc

SEQ ID NO: 17375 - RNA, 432 nt, Artificial Sequence
  derived and/or modified sequence opt2 from anti-HIV_cap256-059-001029_VR-Chain
caggagcagcucguccaguccggcggcggcgucguccagcccggccgcucccuccgccucuccugcgcccccucccaguucaccuucuccgcccacggcaugcacuggguccgccaggcccccggcaagggccucgagugggucgccggcaucuccuucgccggcaccaagaacuacuacgccgacuccgucaagggccgcuucaccaucucccgcgacaacuccaagaacacccucuaccuccagaugaacucccuccgcgucgaggacaccgcccucuacuacugcgccaaggacaugcgcgagauggagugcgaggagugggccuccgacuacuacgacuucggccgccaccagcccugccaggacccccgcggcgucgucggcaucuucgacaucuggggccagggcaccauggucaccgucuccucc

SEQ ID NO: 17376 - RNA, 432 nt, Artificial Sequence
  derived and/or modified sequence opt2 from anti-HIV_cap256-048-165087_VR-Chain
gaggucaagcuccucgaguccggcggcggccucguccagcccggcggcuaccgccgccucuccugcgccgccuccggcuucaccuucucccgcuacgccaugcacugggcccgccaggcccccggcaagggccucgagugggucgccgucgucuccgacgacggcgucaagaaguacuaccccgacuccguccgcggccgcuucaccaucucccgcgacaacucccgcaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17377 - RNA, 432 nt, Artificial Sequence
  derived and/or modified sequence opt2 from anti-HIV_cap256-048-158861_VR-Chain
gagguccagcucgucgaguccggcggcggccucguccagcccggcggcucccuccgccucuccugcgucgacuucggcuuccgcuucuccgaguacuggauguccuggguccgccaggcccccggcaagggccucgagugggucgccgucaucuccuacgacggcaccaacaaguacuacgccgacuccgucaagggccgcuucaccaucucccgcgacaacuccaagaacacccucuaccuccagaugaacucccuccgcgccgaggacaccgcccucuacuacugcgccaaggacaugcgcgaguccgagugcgaggagugggccuccgacuacuacgacuucggcaaggacuaccccugccaggacccccgcggcgucgucggcaccuucgacaucuggggccagggcaccauggucaccgucuccucc

SEQ ID NO: 17378 - RNA, 435 nt, Artificial Sequence
  derived and/or modified sequence opt2 from anti-HIV_cap256-048-158280_VR-Chain
cagguccaccucgucgaguccggcggcggcgucguccagcccggccgcucccuccgcaucuacugcgccgucuccgaguucaccuuccgcaacuacgccaugcacuggguccgccucgcccccggcaagggccuccagugggucgccgucaucucccacgacggcaucaacgacuacuacgccgacuccgucaagggccgcuucaccaucucccgcgacaacuccaagaacaccgucucccuccagaugaacucccuccgccccgaggacaccgccgucuacuacugcgccaaggaccucggcgccaacaaggacgacgagugggccaccgacuacuacgaccucuccaucgccuaccccguccccgaccccaccggccccugguucggcgccuucgacaucuggggccagggcaccauggucaccgucuccucc

SEQ ID NO: 17379 - RNA, 432 nt, Artificial Sequence
  derived and/or modified sequence opt2 from anti-HIV_cap256-048-157928_VR-Chain
cagguccagcucauggaguccggcggcggcgucguccagcccggccgcucccuccgccucuccugcgccaucuccggcuucaccuucuccaacuacuggauguccuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17380 - RNA, 432 nt, Artificial Sequence
  derived and/or modified sequence opt2 from anti-HIV_cap256-048-157056_VR-Chain
cagguccagcucgucgaguccggcggcggcgucguccagcccggccgcucccuccgccucuccugcgccgccuccggcuucacccucuccuccuacgccaugcacuggguccgccaggcccccggcaagggccucgagugggucgccuucaucuccaacgacggcuccaacaaguacuucgccgacuccgucaagggccgcuucaccaucucccgcgacaacuccaagaacacccucuaccuccagaugaacucccuccgcgccgaggacaccgccgucuacuacugcgccaaggaccucggcggcaacaaggacgacgagugggccaccgacuacuacgaccucuccaucgccuaccccguccaggacccccgcgucgucgucggcaucuucgacaucuggggccagggcaccauggucaccgucuccucc

SEQ ID NO: 17381 - RNA, 432 nt, Artificial Sequence
  derived and/or modified sequence opt2 from anti-HIV_cap256-048-156422_VR-Chain
cagguccagcucgucgaguccggcggcaccgucguccagcccggccgcucccuccgccucuccugcgucggcuccggcuucucccucuccuacuacgccauccacuggguccgccaggcccccggcaagggccucgagugggucgccgucaucuccuacgacggcuccaacuacuacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17382 - RNA, 432 nt, Artificial Sequence
  derived and/or modified sequence opt2 from anti-HIV_cap256-048-152863_VR-Chain
gagguccagcuccucgaguccggcggcggccucguccagcccggcggcucccuccgccucuccugcgccggcuccggcuucaccuucuccaagcacggcaugcacuggguccgccaggcccccggcaagggccucgagugggucgccuucgucgccuucgacgaguccgacaaguacuacgccgacuccgucaagggccgcuucaccaucucccgcgacaacuccaagaacacccucucccuccagaugaacucccuccgcgccgaggacaccgccauguacuacugcgccaaggaggucggcgacaacaaggacgacgagugggccuccgacuacuacgaccucuccaucgccuaccccguccacgacccccgcgccgucgucggcggcuacgacaucuggggccagggcaccauggucaccgucuccucc

SEQ ID NO: 17383 - RNA, 432 nt, Artificial Sequence
  derived and/or modified sequence opt2 from anti-HIV_cap256-048-152770_VR-Chain
cagguccagcucgucgaguccggcggcggcgucguccagcccggccgcucccuccgccucuccugcgccgccuccggcuucaccuuccgcuccaacgccaugcacuggguccgccaggcccccggcaagggccucgagugggucgccgucaucuccuacgacggcuccaagaccuacuacgccgacuccgucaagggccgcuucaccaucucccgcgacaacuccaagaacacccucuaccuccagaugaacucccuccgcgccgaggacaccgccgucuacuacugcgccaaggaccucggcgaguacaaguccgacgagugggccaccgacuacuacgaccucuccaucgccuaccccguccaggacccccgcggcgucgccggcgccuucgacaucuggggccagggcaccauggucaccgucuccucc

SEQ ID NO: 17384 - RNA, 432 nt, Artificial Sequence
  derived and/or modified sequence opt2 from anti-HIV_cap256-048-150027_VR-Chain
gagguccagcucgucgaguccggcggcggccucguccagcccggcggcucccuccgccucuccugcgccgucuccggcuucaccuucuccuccuacaucaugcacuggguccgccaggcccccggcaagggccucgagugggucgccgucaucuccuacgacggcuccaacaaggacuacgccgacuccgucaagggccgcuucaccaucucccgcgacaacuccaagaacacccucuaccuccagaugaacucccuccgcgccgaggacaccgcccucuacuacugcgccaaggaccuccgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17385 - RNA, 432 nt, Artificial Sequence
  derived and/or modified sequence opt2 from anti-HIV_cap256-048-148246_VR-Chain
cagguccagcucgucgaguccggcggcggcgucguccagcccggccgcucccuccgccucuccugcgccaccuccggcuucaccuucuccaccuacuccaugcacuggguccgccaggcccccggcaagggccucgagugggucgccgucaucuccuacgacggcuccaacgaguacuacgucgacuccgucaagggccgcuucaccaucucccgcgacaacuccaagaacacccucuaccuccagaugaacucccuccgcgucgaggacaccgcccucuacuacugcgccaaggaccucggcggcaacaaggacgacgaguggggcaccgacuacuacgacuucuccgucgccuaccccguccaggacccccgcgccgucuccggcaucuucgacgucuggggccacggcaccauggucaccgucuccucc

SEQ ID NO: 17386 - RNA, 432 nt, Artificial Sequence
  derived and/or modified sequence opt2 from anti-HIV_cap256-048-147428_VR-Chain
cagguccagcucgucgaguccggcggcggcgucguccagcccggccgcucccuccgccucuccugcuccgccuccggcuucaccuucuccaacuacggcaugcacuggguccgccaggcccccggcaagggccucgagugggucgccgucaucuccuucgacggcuccaacaaggucuacgccgacuccgucaagggccgcuucaccaucucccgcgacaacuccaagaacacccucuaccucgagaugaacucccuccgcgccgaggacaccgccgaguacuacugcgccaaggaccucggcgaguccgacaaggaggaguggcccuccgacuacuacgacuucggccgcgacuucaccggccaggucccccgcgccgucgucggcaucuucgacauguggggccagggcaccauggucaccgucuccucc

SEQ ID NO: 17387 - RNA, 432 nt, Artificial Sequence
  derived and/or modified sequence opt2 from anti-HIV_cap256-048-146603_VR-Chain
gagguccagcucgucgaguccggcggcggccucguccagcccggccgcucccuccgccucuccugcgccgccuccggcuucaccuucgacgacuacgccauccacuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccgucuaccacugcgccaaggaccucggcggcaccaaguccgacgagugggccaccgacuacuacgaccucuccaucgccuaccccauccaggaccccggcgccgucgucggcgucuucgacaucuggggccagggcaccauggucaccgucuccucc

SEQ ID NO: 17388 - RNA, 432 nt, Artificial Sequence
  derived and/or modified sequence opt2 from anti-HIV_cap256-048-145735_VR-Chain
cagguccagcucguccaguccggcggcggcgucguccagcccggccgcucccuccgccucuccugcggcgccuccggcuucaccuucuccaacuacgccaugcacuggguccgccaggcccccggcaagggccucgacugggucgccgucaucuccuacgacggcaccaacgagaaccacgccgacuccgucaagggccgcuucaccaucucccgcgacaacuccaagaacaccgucuaccuccagaugaacucccuccgcgccgaggacaccgccgucuacuacugcgccaaggacgucggcggcuccaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17389 - RNA, 432 nt, Artificial Sequence
  derived and/or modified sequence opt2 from anti-HIV_cap256-048-145116_VR-Chain
cagguccaccucgucgaguccggcggcggcgucguccagcccggcggcucccuccgccucuccugcgccgccuccggcuucaccuucuccaacuacggcaugcacuggguccgccaggcccccggcaagggccucgagugggucgccgccaucuccuucgccggcaccaacaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguccgagugcgaggagugggccuccgacuacuacgacuucggccgcgacuaccccugccaggacccccgcggcgucgucggcacccucgacaucuggggccagggcaccauggucaccgucuccucc

SEQ ID NO: 17390 - RNA, 432 nt, Artificial Sequence
  derived and/or modified sequence opt2 from anti-HIV_cap256-048-144077_VR-Chain
caggucaagcucgucgaguccggcggcggcgucguccagcccggccgcucccuccgccucuccugcgccgccuccggcuucacccucuccuccuacgccaugcacuggguccgccaggcccccggcaagggccucgagugggucgccgucaucuccuacgacggcuccaaccgcuacaccgccgacuccgucaagggccgcuucaccaucucccgcgacaacuccaagaacacccucaaccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccaccgucaccgucuccucc

SEQ ID NO: 17391 - RNA, 432 nt, Artificial Sequence
  derived and/or modified sequence opt2 from anti-HIV_cap256-048-142876_VR-Chain
cagguccagcucgucgaguccggcggcggcgucguccagcccggcggcucccuccgccucuccugcgucgccuccggcuucaccuucuccaccuacggcaugcacuggguccgccaggcccccggcaagggccucgagugggucgccuucaugcgcuucgacggcuccaaccgcuacuacggcgacuccgucaagggccgcuucaccaucucccgcgacaacuccaagaacacccucuaccuccagaugaucucccuccgcgccgaggacaccgccgucuaccacugcgccaaggaccucggcggcaacaagcccgacgagugggccaccgacuacuacgaccucuccaucgccuaccccguccaggacccccgcgccgucgucggcgucuucgacaucuggggccagggcaccaucaucaccgucuccucc

SEQ ID NO: 17392 - RNA, 432 nt, Artificial Sequence
  derived and/or modified sequence opt2 from anti-HIV_cap256-048-140582_VR-Chain
cagguccagcucgucgaguccggcggcggcgucguccagcccggccgcucccuccgccucuccugcgccgccuccggcuucuccuucuccaacuacgccauggacuggguccgccaggcccccggcaagggccucgagugggucgccuucgucuccuccgacggcuccaacaagaacuacgccgacuccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17393 - RNA, 432 nt, Artificial Sequence
  derived and/or modified sequence opt2 from anti-HIV_cap256-048-139355_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccaucaucuccuacgacggcuccaacaaguacuacgccgacuccgucaagggccgcuucaccaucucccgcgacaacuccaagggcacccucuaccuccagauggacggcccccgccccgaggacaccgcccucuacuacugcgccaaggaccucggcgagcgcgagugcgaggagugggccuccgacuacuacgacuucggccgcgacuuccccugccaggacccccgcggcgucgucggcaccuucgacaucuggggccagggcaccauggucaccgucuccucc

SEQ ID NO: 17394 - RNA, 432 nt, Artificial Sequence
  derived and/or modified sequence opt2 from anti-HIV_cap256-048-139151_VR-Chain
cagguccagcucgucgaguccggcggcggcgucguccagcccggcaagucccuccgccucuccugcgccgccuccggcuucaccuucaacaccuacggcaugcacuggguccgccaggcccccggcaagggccucgagugggucgccgucaucuccuacgacggcuccauccagaaguacgccgacuccgucaagggccgcuucaccaucucccgcgacaacuccaagaacacccucuaccuccagaugaacucccucuccgucgaggacaccgccgucuacuacugcgccaaggaccucggcaagaacaaggacgacgagugggccaccgacuacuacgacaucuccaucgccuaccccguccccgacccccgcgccgucgucggcgucuucgacaucuggggccagggcaccgucgucaccgucuccucc

SEQ ID NO: 17395 - RNA, 432 nt, Artificial Sequence
  derived and/or modified sequence opt2 from anti-HIV_cap256-048-137672_VR-Chain
gagguccagcucgucgaguccggcggcggcgucgcccgccccggcggcucccuccgccucuccugcgccgccuccggcuucaucuucacccacuacgccauggacuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17396 - RNA, 432 nt, Artificial Sequence
  derived and/or modified sequence opt2 from anti-HIV_cap256-048-137506_VR-Chain
cagguccgccucgucgacuccggcggcggcgucguccagcccggcggcucccuccgccucuccugcgccgccuccggcuucaccuucuccaccuacggcaugcacuggguccgccaggcccccggcaagggccucgagugggucgccuucauccgcuccgacggcuccaacaaguacuacgccgacuccguccagggccgcuucuccaucucccgcgacaacuccaagaacacccucuaccuccagaugaacucccuccgcgccgaggacaccgccgucuacuacugcgccaaggaccucggcgaguccgacaaggaggaguggcccuccgacuacuacgacuucggccgcgacuucaccggccaggacccccgcgccgucgucggcgucuucgacaucuggggccagggcaccaccgucaucgucuccucc

SEQ ID NO: 17397 - RNA, 432 nt, Artificial Sequence
  derived and/or modified sequence opt2 from anti-HIV_cap256-048-137270_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaugucccccgacggcuccaaccgcuacuacaccgacuccgucaagggccgcuucaccaucucccgcgacaacuccaagaacacccucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17398 - RNA, 432 nt, Artificial Sequence
  derived and/or modified sequence opt2 from anti-HIV_cap256-048-135447_VR-Chain
gagguccagcucgucgaguccggcggcgccgucguccagcccggccgcucccuccgccucuccugcaccgccuccggcuucuccuucaccuccuacaccauccacuggguccgccaggcccccggcaagggccucgagugggucgccuucaucuccuacgacggcaccgagaagaaguacaccgacuccgucaagggccgcuucaccaucucccgcgacaacuccaagaacacccucucccuccagaugaacucccuccgccccgaggacaccgccgucuacuacugcgccaaggaccucggcgccuccaaggacgacgagugggccaccgacuacuacgacuucuccaucgccuaccccguccaggacccccgcgccgucgucggcgccuucgacaucuggggccagggcaccauggucaccgucuccucc

SEQ ID NO: 17399 - RNA, 432 nt, Artificial Sequence
  derived and/or modified sequence opt2 from anti-HIV_cap256-048-131966_VR-Chain
caggagcagcucgucgaguccggcggcggcgucguccagcccggccgcucccuccgccucuccugcgccgccuccggcuucaccuucuccaacuacgccaugcacuggguccgccaggcccccggcaagggccucgagugggucgccgccaugucccacgacggcuccgacaaguacuacgccgacuccgucaagggccgcuucaccaucucccgcgacaacuccaagaacacccucuacaugcagaugaacucccuccgcgccgaggacaccgccgucuacuacugcgccaaggaccagggcgaguccgagaaggaggagugggccuccgacuacuacgacuucggccgcgacuaccccggccaggacccccgccgcgucgucgccaccuucgccaucuggggccagggcaccauggucaccgucuccucc

SEQ ID NO: 17400 - RNA, 432 nt, Artificial Sequence
  derived and/or modified sequence opt2 from anti-HIV_cap256-048-131008_VR-Chain
gagguccgccucgucgaguccggcggcggccucgucaagcccggcggcucccuccgccucuccugcgccgccuccggcuucaccgucuccuccaacuacauguccuggguccgccaggcccccggcaagggccucgagugggucgccgccaucuccuucgccggcaccaacaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguccgagugcgaggagugggccuccgacuacuacgacuucggccgcgacuaccccugccaggacccccgcggcgucgucggcacccucgacaucuggggccagggcaccauggucaccgucuccucc

SEQ ID NO: 17401 - RNA, 432 nt, Artificial Sequence
  derived and/or modified sequence opt2 from anti-HIV_cap256-048-129369_VR-Chain
cagguccagcucgucgaguccggcggcggcgucguccagcccggccgcucccuccgccucuccugcgccgccuccggcuucaccuucuccaacuacgucaugcacuggguccgccaggcccccggcaagggccucgagugggucgcccucgucuccuucgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17402 - RNA, 432 nt, Artificial Sequence
  derived and/or modified sequence opt2 from anti-HIV_cap256-048-128476_VR-Chain
gagguccagguccucgaguccggcggcggccucguccagcccggcggcucccuccgccucgccugcgccgccuccggcuucuccuucuccuccuacggcaugcacuggguccgccaggcccccggcaagggccucgagugggucuccuucauccgcuacgacggcgccaacaaguaccacgccgacuccgucaagggccgcuucaucaucucccgcgacgacuccaagaacaccgucucccuccagaugaacucccuccgccccgaggacaccgccgucuacuacugcgccaaggaccucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17403 - RNA, 432 nt, Artificial Sequence
  derived and/or modified sequence opt2 from anti-HIV_cap256-048-128270_VR-Chain
cagguccagcucgucgaguccggcggcggcgucguccagcccggccgcucccuccgccucuccugcaccgccuccggcuucaccuuccgcuccuacgccaugcacuggguccgccaggcccccggcaagggccucgagugggucgcccucaucuccuacgacggcuccaacaaguacuacgccgacuccgucaagggccgcuucaccaucucccgcgacaacuccaagaacacccucuaccuccagaugaacucccucaccuccgaggacaccgccgucuacuacugcgccaaggaccucggcggcuccaagaccgacgaguggggcaccgacuacuacgaguucuggaacgccuaccccguccaggacccccgcgucgucgucggcgccuucgacaucuggggccacggcaccauggucaccgucuccucc

SEQ ID NO: 17404 - RNA, 432 nt, Artificial Sequence
  derived and/or modified sequence opt2 from anti-HIV_cap256-048-126220_VR-Chain
cagguccagcucgucgaguccggcggcggcgucguccagcccggccgcucccuccgccucuccugcgccgccuccggcuucaucuucucccccuacggcauccacuggguccgccaggcccccggcaagggccucgagugggucgcccucaucucccacgacggcuccaagaaguacuacgccgacuccgucaagggccgcuucaccaucucccgcgacaacuucaaggacacccucuaccuccagaugaacucccuccgcggcgucgacaccgccgucuacuacugcgccaaggaccucggcggcggcgaggucgaggagugggccaccgacuacuacgacugguccaccgccuaccccgucgagcacccccgcgccgucgucggcgucuucgacaucuggggccagggcaccaaggucaccgucuccucc

SEQ ID NO: 17405 - RNA, 432 nt, Artificial Sequence
  derived and/or modified sequence opt2 from anti-HIV_cap256-048-125713_VR-Chain
gagguccagcucgucgaguccggcggcggccucguccagcccggcggcucccuccgccucuccugcgaggccuccggcuucuccuucuccaccuacgagcucaacuggguccgccaggcccccggcaagggccucgagugggucgccgucaucuccuacgacggcuccaacuacuacuacgccgacuccgucaagggccgcuucaccaucucccgcgacaacuccaagaacacccucuaccuccagaugaacucccuccgcgccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17406 - RNA, 432 nt, Artificial Sequence
  derived and/or modified sequence opt2 from anti-HIV_cap256-048-123934_VR-Chain
cagguccagcucgucgaguccggcggcggcgucguccagcccggccgcucccuccgccucuccugcgccgccuccggcuucaccuucuccuccuacggcauggccuggguccgccaggcccccggcaagggccucgagugggucaccgccaucuccuucgccggcaccaacaaguacuacgccgacuccgucaagggccgcuucaccaucucccgcgacaacuccaaggacacccucuaccuccagauggacggccuccgccccgaggacaccgcccucuacuacugcgccaaggaccucggcgagcgcgagugcgaggagugggccuccgacuacuacgacuucggccgcgacuuccccggccaggaccagcgcgccgucgccggcgucuucgacauguggggccagggcaccauggucaccgucuccucc

SEQ ID NO: 17407 - RNA, 432 nt, Artificial Sequence
  derived and/or modified sequence opt2 from anti-HIV_cap256-048-122673_VR-Chain
gagguccaggucgucgaguccggcggcggccucgucaagcccggcggcucccuccgccucuccugcgccgccuccggcuucaccuucuccucccacgucaugaacuggguccgccaggcccccggcaagggccucgagugggucuccuccaucuccggcggcuccuccuccaaggacuacgccgacuccgucaagggccgcuucaccaucucccgcgacaacuccaagaacacccucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17408 - RNA, 432 nt, Artificial Sequence
  derived and/or modified sequence opt2 from anti-HIV_cap256-048-122208_VR-Chain
cgcguccaggucgucgaguccggcggcggcgucgucaagcccggcggcucccuccgccucuccugcggcgccuccggcuucaccuucuccaacgccuggcucuccuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17409 - RNA, 432 nt, Artificial Sequence
  derived and/or modified sequence opt2 from anti-HIV_cap256-048-121552_VR-Chain
cagguccagcucgucgaguccggcggcggcgucguccagcccggcggcucccuccgccucuccugcgccgccuccggcuucaccuucuccuccuacgccaugcacuggguccgccaggcccccggcaagggccucaagugggucgccgacaucuccuacgacgccuccuccaaguacuacgccgacuccgucaagggccgcuucaccaucucccgcgacaacuccaagaacacccucuaccucgagaugaacucccuccgccccgaggacaccgccgucuacuacugcgccaaggaccucggcgagcgcgagugcgaggagugggccuccgacuacuacgacuucggccgcgacuuccccugccaggacccccgcggcgucgucggcaccuucgacaucuggggccagggcaccauggucaccgucuccucc

SEQ ID NO: 17410 - RNA, 432 nt, Artificial Sequence
  derived and/or modified sequence opt2 from anti-HIV_cap256-048-120643_VR-Chain
cagguccagcucgucgaguccggcggcggcgucguccagcccggccgcucccuccgccucuccugcgccgccuccggcuucacccucuccgccuacaccaugcacuggguccgccaggcccccggcaagggccucgagugggucuccgucaucuccuucgccggcaacaacaaguacuacgccgacuccgucaagggccgcuucaccaucucccgcgagaacuccaagaacaugcucuaccuccagaugaacucccuccgcggcgaggacaccgccgucuacuacugcgccaaggaccuccgcgaguucgagugcgaggagugggccuccgacuacuacgacuucggccgcgacuaccccugccaggacccccgcggcgucgucggcaccuucgacgucuggggccacggcucccucgucaccgucuccucc

SEQ ID NO: 17411 - RNA, 432 nt, Artificial Sequence
  derived and/or modified sequence opt2 from anti-HIV_cap256-048-118458_VR-Chain
cagguccagcucgucgaguccggcggcggcgucguccagcccggccgcucccuccgccucuccugcgccgccuccggcuucaccuucuccaccuccggcaugcacuggguccgccaggcccccggcaagggccucgagugggucgccuucaucuccuccgaccgcuccaacaaguucuacgccgacuccgucaagggccgcuucuccaucucccgcgacaacuccaaguacacccucuaccuccagaugaacucccuccgcgccgacgacaccgccgucuacuucugcgccaaggaccucggcgucaacaagaacgacgagugggccaccgacuacuacgaccucuccgucgccuaccccguccaggacccccgcggcgucgccggcaucuucgacaucuggggccagggcaccauggucaccgucuccucc

SEQ ID NO: 17412 - RNA, 432 nt, Artificial Sequence
  derived and/or modified sequence opt2 from anti-HIV_cap256-048-118112_VR-Chain
caggagcagcucgucgaguccggcggcggcgucguccagcccggccgcucccuccgccucuccugcgccgccucccaguucaccuucuccaacuacggcaugcacuggguccgccaggcccccggcaagggccucgucugggucgccggcaucuccuucgccggcaccaacaaguacuacgccgccuccgucaagggccgcuucaccaucucccgcgacaacuccaagaacacccucuaccuccagaugaacucccuccgcgccgaggacaccgcccucuacuacugcgccaaggacaugcgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17413 - RNA, 432 nt, Artificial Sequence
  derived and/or modified sequence opt2 from anti-HIV_cap256-048-116469_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccaucaucuccuacgacggcuccaacaaguacuacgccgacuccgucaagggccgcuucaccaucucccgcgacaaccccaagaacacccucuaccuccagaugaacucccuccgcgccgaggacaccggccucuacuacugcgccaaggacaugggcgaguccgagaaggaggagugggccuccgacuacuacgacuucggccgcgacuaccccggccaggagccccgcgccauggucggcaccuucgacaucuggggccagggcaccauggucaccgucuccucc

SEQ ID NO: 17414 - RNA, 432 nt, Artificial Sequence
  derived and/or modified sequence opt2 from anti-HIV_cap256-048-113917_VR-Chain
gagguccagcucgucgaguccggcggcggccucguccagcccggcggcucccuccgccucuccugcgccgccuccggccucaccgucuccgacaccuacaugaacuggcuccgccaggcccccggcaagggccucgagugggucgccgucgucuccuccgacggcuccaacaagaacuacgccgacuccgucaagggccgcuucaccaucucccgcgacaacuccaagaacaccgucuaccuccagaugaacucccuccgcgccgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17415 - RNA, 432 nt, Artificial Sequence
  derived and/or modified sequence opt2 from anti-HIV_cap256-048-112368_VR-Chain
cagguccagcucgucgaguccggcggcggcgucguccagcccggccgcucccuccgccucuccugcgccgccuccggcuucaccuucucccgcaacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcggcggcgaggucgaggagugggccaccgacuacuacgacugguccaccgccuaccccgucgagcacccccgcgccgucgucggcgucuucgacaucuggggccagggcaccaaggucaccgucuccucc

SEQ ID NO: 17416 - RNA, 432 nt, Artificial Sequence
  derived and/or modified sequence opt2 from anti-HIV_cap256-048-112047_VR-Chain
gagguccagcucgucgaguccggcggcggccucguccagcccggcggcucccuccgccucuccugcgccgccuccggccucaccgucuccggcuacuacauguccuggguccgccaggcccccggcaagggccucgaguggcucgccuucauccacuucgacggcuccaagauccacuacgccggcuccgucaagggccgcaucaccgucucccgcgacaacuccaagaacacccucgaccuccagaugaacucccuccgcgccgaggacaccgccgucuacuacugcgccaaggacgucggcgacuccaaguccgacgagugggccaccgacuacuacgaccucuccgucgccuaccccguccccgacccccgcgccgucgucggcgccuucgacaucuggggccagggcaccauggucaccgucuccucc

SEQ ID NO: 17417 - RNA, 432 nt, Artificial Sequence
  derived and/or modified sequence opt2 from anti-HIV_cap256-048-112029_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuucgccggcaucaagaaguacuacgccgacuccgucaagggccgcuucaccaucucccgcgacaacuccaagaacacccucuaccuccagaugaacucccuccgcggcgaggacaccgcccucuacuacugcgccaaggaccuccgcgaguacgagugcgaggagugggccuccgacuacuacgacuucggccgcgacuaccccugccaggacccccgcggcgucgucggcaucuucgacaucuggggccagggcaccauggucaccgucuccucc

SEQ ID NO: 17418 - RNA, 432 nt, Artificial Sequence
  derived and/or modified sequence opt2 from anti-HIV_cap256-048-110957_VR-Chain
cagguccgccucgucgaguccggcggcggcgucguccgcuccggccgcucccuccgccucuccugcgccgccuccggcuucaccuucuccaacuucgcccuccacuggguccgccaggcccccggcaagggccucgagugggucgccgucaucuccuacgacggcaacuccaaguucuacgccgacuccgucaagggccgcuucaccaucuccaccgacaacuccaagaacacccucuaccuccagaugaacucccucaccgccgaggacaccgccgucuacuacugcgccaaggaccucggcggcaacaaggacgacgaguggggcaccgacuacuacgacuucuccgucgccuaccccguccaggacccccgcgccgucuccggcaucuucgacgucuggggccacggcaccauggucaccgucuccucc

SEQ ID NO: 17419 - RNA, 432 nt, Artificial Sequence
  derived and/or modified sequence opt2 from anti-HIV_cap256-048-110526_VR-Chain
cagguccagcucgucgaguccggcggcggcgucguccagcccggccgcucccuccgccucuccugcgccgccuccggcuucaccuucuccaacuucggcuuccacuggguccgccaggcccccggcaagggccucgagugggucgccgccaucuccuucgccggcaacaacaaguacuacgccgacuccgucaagggccgcuucaccaucucccgcgagaacuccaagaacauccucuaccuccagaugaacucccuccgcggcgaggacaccgccgucuacuacugcgccaaggaccuccgcgaguucgagugcgaggagugggccuccgacuacuacgacugguccaccgccuaccccgucgagcacccccgcgccgucgucggcgucuucgacaucuggggccagggcaccaaggucaccgucuccucc

SEQ ID NO: 17420 - RNA, 432 nt, Artificial Sequence
  derived and/or modified sequence opt2 from anti-HIV_cap256-048-109336_VR-Chain
gagguccagcucgucgaguccggcggcggccucguccagcccggcggcucccagcgccucuccugcgccgccuccggccucaccgucaacuccaacuacaugaccuggguccgccaggcccccggcaagggccucgagugggucgccaucaucuccuccgacggcuccggccaguacuacgccgacuccgucaagggccgcuucaccaucucccgcgacaacuccaagaacacccucucccuccagaugaacucccuccgccccgaggacaccgccgucuacuacugcgccaaggaccucggcgccuccaaggacgacgagugggccaccgacuacuacgacuucuccaucgccuaccccguccaggacccccgcgccgucgucggcgccuucgacaucuggggccagggcaccauggucaccgucuccucc

SEQ ID NO: 17421 - RNA, 432 nt, Artificial Sequence
  derived and/or modified sequence opt2 from anti-HIV_cap256-048-108152_VR-Chain
caggcccagcucgucgaguccggcggcggcgucguccagcccggccgcucccucguccucuccuccgucgccuccggcuucuccuucuccaccuacgccaugcacuggguccgccaggcccccggcaagggccucgagugggucgccgucaucuccuacgacggcggcaacaaguacuacgccgacuccgucaagggccgcuucuccaucucccgcgacaacuccaagaacaccgucuaccuccagaucaacucccuccgcgccgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17422 - RNA, 432 nt, Artificial Sequence
  derived and/or modified sequence opt2 from anti-HIV_cap256-048-107799_VR-Chain
gagguccaggucgucgaguccggcggcggcgucguccagcccggccgcucccuccgccucuccugcgccgccuccggcuucaccuucuccaacuacgccauggacuggguccgccaggcccccggcaagggccucgagugggucgccuucgucuccuccgacggcuccaacaagaacuacgccgacuccgucaagggccgcuucaccaucucccgcgacaacuccaagaacacccucucccuccagaugaacucccuccgcgccgaggacaccgccgucuacuacugcgccaaggaggucggcgagaacaaggacgacgagugggccuccgacuacuacgaccucuccaucgccuaccccauccacgacccccgcgccgucgucggcggcuucgacaucuggggccagggcaccauggucaccgucuccucc

SEQ ID NO: 17423 - RNA, 432 nt, Artificial Sequence
  derived and/or modified sequence opt2 from anti-HIV_cap256-048-107384_VR-Chain
gagguccgccucgucgaguccggcggcgcccucgucaagcccggcaccucccuccgccucuccugcgccgccuccggcuucaccuucacccacuacgccauggacuggguccgccaggcccccggcaagggccucgagugggucgccaucaucuccuccgacggcuccaccaagaacuacgccgacuccgucaagggccgcuucaccaucucccgcgacaacuccaagaacacccucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17424 - RNA, 432 nt, Artificial Sequence
  derived and/or modified sequence opt2 from anti-HIV_cap256-048-106530_VR-Chain
gagguccagcuccucgaguccggcggcggccucguccagcccggcggcucccuccgccucuccugcgccgccuccggcuucaccuucuccuccuacgccauggacuggguccgccaggcccccggcaagggccucgagugggucgccgucaucuccuccgacggcuccaacaagaacuacgccgacuccgucaagggccgcuucaccaucucccgcgacaacuccaagaacacccucuaccuccagauguccucccuccgccccgaggacaccgccgucuacuacugcgccaaggacgucggcgacuccaaguccgacgagugggccaccgacuacuacgacuucuccaucgccuaccccauccaggacccccgcgccgucgucggcgccuucgacaucuggggccagggcaccauggucaccgucuccucc

SEQ ID NO: 17425 - RNA, 432 nt, Artificial Sequence
  derived and/or modified sequence opt2 from anti-HIV_cap256-048-106464_VR-Chain
gagguccagaugguccaguccggcggcggccucguccagcccggcggcucccuccgccucuccugcgccgccuucggcuucaccuucaccaaccacgccauggacuggguccgccagguccccggcaagggccucgagugggucgccuucaucuccuccgacggcuccaacaagaacuacgccgacuccgucaagggccgcuucaccaucucccgcgacaacuccaagaacaccgucuaccuccagauguccucccuccgccccgaggacaccgccgucuacuacugcgccaaggacgucggcgacuccaaguccgacgagugggccaccgacuacuacgaccucuccgucgccuaccccguccccgacccccgcgccgucgucggcgccuucgacaucuggggccagggcaccauggucaccgucuccucc

SEQ ID NO: 17426 - RNA, 432 nt, Artificial Sequence
  derived and/or modified sequence opt2 from anti-HIV_cap256-048-106411_VR-Chain
cagguccagcucgucgaguccggcggcggcgucguccagcccggccgcucccuccgccucuccugcgccgccuccggcuucaccuucuccuacuccggcaugcacuggguccgccaggcccccggcaagggcauggagugggucgccgucaucuccuacgacggcuccaacaaguacuacgccgacuccgucaagggccgcuucaccaucucccgcgacaacuccaagaacacccucuaccuccagaugaacucccuccgcgucgaggacaccgccgucuaccacugcgccaaggaccucggcggcaccaaguccgacgagugggccaccgacuacuacgaccucuccaucgccuaccccauccaggaccccggcgccgucgucggcgucuucgacaucuggggccagggcaccauggucaccgucuccucc

SEQ ID NO: 17427 - RNA, 432 nt, Artificial Sequence
  derived and/or modified sequence opt2 from anti-HIV_cap256-048-106306_VR-Chain
gagguccagcucgucgaguccggcggcggccucguccagcccggcggcucccuccgccucuccugcgaggccuccggcuucaccuucaacaacuacggcauggucuggguccgccaggcccccggcaagggccucgagugggucgccaucaucuccuacgacggcaccgagaaguacuacgucgacuccgucaagggccgcuucaccaucucccgcgacaacuccaagaacacccucucccuccagaugaacucccuccgcgccgaggacaccgccgucuacuacugcgccaaggaggucggcgagaacaaggacgacgagugggccuccgacuacuacgaccucuccaucgccuaccccauccacgacccccgcgccgucgucggcggcuucgacaucuggggccagggcaccauggucaccgucuccucc

SEQ ID NO: 17428 - RNA, 432 nt, Artificial Sequence
  derived and/or modified sequence opt2 from anti-HIV_cap256-048-104496_VR-Chain
cagguccagcucgucgaguccggcggcggccucgucaagcccggcggcucccuccgccucuccugcgccgccuccggcuucaccuucuccuccuacggcaugcacuggguccgccaggcccccggcaagggccucgagugggucgccuucgucuccuccgacggcaacaacaagaacuacgccgacuccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17429 - RNA, 432 nt, Artificial Sequence
  derived and/or modified sequence opt2 from anti-HIV_cap256-048-103074_VR-Chain
cagguccaccucgucgaguccggcgccggcgucguccagcccggcggcucccuccgccucuccugcgccgucuccggcuucaccuucaacuccuacggcaugcacuggguccgccaggcccccggcaagggccucgagugggucgccgucaucuccuacgacggcuccgacaaguacuacgccgacuccgucaagggccgcuucaccaucucccgcgacuccuccaagaacacccucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17430 - RNA, 432 nt, Artificial Sequence
  derived and/or modified sequence opt2 from anti-HIV_cap256-048-100832_VR-Chain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgccgucgucuccuccgacggcaccaacaagaacuacggcgacuccgucaagggccgcuucaccaucucccgcgacaacucccgcaacaccgucuaccuccagauguccucccuccgccccgaggacaccgccgucuacuacugcgccaaggacgucggcgacaccaaguccgacgagugggccaccgacuacuacgacuucuccaucgccuaccccguccaggacccccgcgccgucgucggcgccuucgacaucuggggccagggcaccauggucaccgucuccucc

SEQ ID NO: 17431 - RNA, 432 nt, Artificial Sequence
  derived and/or modified sequence opt2 from anti-HIV_cap256-048-100188_VR-Chain
cagguccaccucgucgaguccggcggcggcgucguccagcccggccgcucccuccgcaucuacugcgccgucuccgaguucaccuuccgcaacuacgccaugcacuggguccgccucgcccccggcaagggccuccagugggucgccgucaucuccuacaacggcggcaagaaguacuacgccgacuccgucaagggccgcuucaccaucucccgcgacaacuccaagaacgcccucuaccuccagaugaacucccuccgcgccgaggacaccggccucuacuacugcgccaaggaccuccgcgaguucgagugcgaggagugggccuccgacuacuacgacuucggccgcgaguaccccugccaggacccccgcggcgucgucggcaccuucgacaucuggggccagggcaccauggucaccgucuccucc

SEQ ID NO: 17432 - RNA, 432 nt, Artificial Sequence
  derived and/or modified sequence opt2 from anti-HIV_cap256-048-099645_VR-Chain
cagguccagcucgucgaguccggcggcggcgucguccagcccggccgcucccuccgccucuccugcgccgccuccggcuucaccuucucccgcuacgcccuccacuggguccgccaggcccccggcaagggccucgagugggucgccgucaucuccuacgacggcuccuccaaguacuacgccgacuccgucaagggccgcuucuccaucucccgcgacaacuccaaguacacccucuaccuccagaugaacucccuccgcgccgacgacaccgccgucuacuucugcgccaaggaccucggcgucaacaagaacgacgagugggccaccgacuacuacgaccucuccgucgccuaccccguccaggacccccgcggcgucgccggcaucuucgacaucuggggccagggcaccauggucaccgucuccucc

SEQ ID NO: 17433 - RNA, 432 nt, Artificial Sequence
  derived and/or modified sequence opt2 from anti-HIV_cap256-048-098137_VR-Chain
cagguccagcucgucgaguccggcggcggcgucguccagcccggccgcucccuccgccucuccugcgccgccuccggcuucacccuccgcaacuacgccaugcacuggguccgccaggcccccggcaagggccucgagugggucgccgucaucuccuccgacggcaacaacaaguacuacgccgacuccgucaagggccgcuucaccgucucccgcgacaacuccaaggacacccucuaccuccagaugaacucccuccgccccgaggacaccgcccucuacuacugcgccaaggaccucggcgagcgcgagugcgaggagugggccuccaacuacuacgacuucggccgcgacuaccccugccaggacccccgcggcgucgucggcaccuucgacaucuggggccagggcaccauggucaccgucuccucc

SEQ ID NO: 17434 - RNA, 432 nt, Artificial Sequence
  derived and/or modified sequence opt2 from anti-HIV_cap256-048-097878_VR-Chain
cagguccagcuccucgaguccggcggcggcgucguccagcccggcaagucccuccgccucuccugcgccgccuccggcuucaccuucaacaccuacggcaugcacuggguccgccaggcccccggcaagggccuccagugggucgccgucaucuccuacgacggcaccauccagaaguacgccgacuccgucaagggccgcuucaccaucucccgcgagaacuccaagaacaugcucuaccuccagaugaacucccuccgcggcgaggacaccgccgucuacuacugcgccaaggaccuccgcgaguucgagugcgaggagugggccuccgacuacuacgacuucggccgcgacuaccccugccaggacccccgcggcgucgucggcaccuucgacgucuggggccacggcucccucgucaccgucuccucc

SEQ ID NO: 17435 - RNA, 432 nt, Artificial Sequence
  derived and/or modified sequence opt2 from anti-HIV_cap256-048-097510_VR-Chain
cagguccagcucgucgaguccggcggcggcgucguccagcccggccgcucccucuggcucuccugcgccgccuccgaguucacccuccgcuccuacggcaugcacuggguccgccaggcccccggcaagggccucgagugggucgccuucgucgccuucgacgaguccgacaaguacuacgccgacuccgucaagggccgcuucaccaucucccgcgacaacuccaagaacacccucucccuccagaugaacucccuccgcgccgaggacaccgccgucuacuacugcgccaaggaggucggcgacaacaaggacgacgagugggccuccgacuacuacgaccucuccaucgccuaccccguccacgacccccgcgccgucgucggcggcuucgacaucuggggccagggcaccauggucaccgucuccucc

SEQ ID NO: 17436 - RNA, 432 nt, Artificial Sequence
  derived and/or modified sequence opt2 from anti-HIV_cap256-048-097313_VR-Chain
cagguccagcucgucgaguccggcggcggccucguccagcccggcggcgcccuccgccucuccugccucgucuccggcuucaccuucgacgacuacgcccuccacuggguccgccaggcccccggcaagggccccgagugggucgccguccucuccuccgacggcuccuacaaguacuacaccgaguccguccagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17437 - RNA, 432 nt, Artificial Sequence
  derived and/or modified sequence opt2 from anti-HIV_cap256-048-096626_VR-Chain
gagguccagcucgucgaguccggcggcggccucguccagcccggcgagucccuccgccucuccugcgccggcuccggcuucaccuucuccuccuacuggauguccuggguccgccaggcccccggcaagggccucgaguggauggcccucaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgccaaggaccucggcggcaacaaggacgacgagugggccaccgacuacuacgaccucuccaucgccuaccccguccaggacccccgcgucgucgucggcaucuucgacaucuggggccagggcaccauggucaccgucuccucc

SEQ ID NO: 17438 - RNA, 432 nt, Artificial Sequence
  derived and/or modified sequence opt2 from anti-HIV_cap256-048-096483_VR-Chain
gagguccagcucgucgaguccggcggcggccucguccagcccggccgcucccuccgccucuccugcgccgccuccggcuucuccuucgaggacuacgccaugcacuggguccgccaggcccccggcaagggccucgagugggucgccggcaucuccuucgccggcaccaagaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17439 - RNA, 432 nt, Artificial Sequence
  derived and/or modified sequence opt2 from anti-HIV_cap256-048-095691_VR-Chain
cagguccagcucgucgaguccggcggcggcgucguccagcccggccgcucccuccgccucuccugcgccgccuccggcuucaccuucuccuccuacggcauggccuggguccgccaggcccccggcaagggccucgagugggucaccgccaucuccuucgccggcaccaacaaguacuacgccgacuccgucaagggccgcuucaccaucucccgcgacaacuccaaggacacccucuaccuccagauggacggccuccgccccgaggacaccgcccucuacuacugcgccaaggaccucggcgagcgcgagugcgaggagugggccuccaacuacuacgacuucggccgcgacuaccccugccaggacccccgcggcgucgucggcaccuucgacaucuggggccagggcaccauggucaccgucuccucc

SEQ ID NO: 17440 - RNA, 432 nt, Artificial Sequence
  derived and/or modified sequence opt2 from anti-HIV_cap256-048-095525_VR-Chain
cagguccagcucguccaguccggcggcuccgucguccagcccggcaagucccuccgccucuccugcgccgccuccggcuucaccuucuccuccuucggcaugcacuggguccgccagacccccggcaagggccucgagugggucgccgucaucuccuacgacggcuccgagaaguccuacgccgacuccgucaagggccgcuucaccaucucccgcgacaacuccaagaacacccucuaccuccagaugaacucccuccgcgccgaggacaccgccgucuacuacugcgccaaggaccucggcggcaccaaggacgacgagugggccaccgacuacuacgacaucuccaucgccuaccccguccaggacccccgcgccgucgccggcgccuucgacaucuggggccagggcaccauggucaccgucuccucc

SEQ ID NO: 17441 - RNA, 432 nt, Artificial Sequence
  derived and/or modified sequence opt2 from anti-HIV_cap256-048-094783_VR-Chain
gagguccagcucgucgaguccggcggcggccucgucaagcccggcggcucccuccgccucuccugcgccgccuccggcaucaccuucuccaccuacgagaugaacuggguccgccaggcccccggcaagggcauggagugggucgccgucaucuccuacgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17442 - RNA, 432 nt, Artificial Sequence
  derived and/or modified sequence opt2 from anti-HIV_cap256-048-094356_VR-Chain
cagguccagcucgucgaguccggcggcggcgucguccagcccggccgcucccuccgccucuccugcgccgccuccggcuucaucuucacccacuacgccauggacuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggacgucggcgacaacaaguccgacgagugggccaccgacuacuacgacuucuccaucgccuaccccguccccgacccccgcgccgucgucggcgccuucgaccucuggggccagggcaccauggucaccgucuccucc

SEQ ID NO: 17443 - RNA, 432 nt, Artificial Sequence
  derived and/or modified sequence opt2 from anti-HIV_cap256-048-090756_VR-Chain
cagguccagcucgucgaguccggcggcggcgucguccgccccggccgcucccuccgccucuccugcgccgucuccggcuucaccuucuccaacuacgccauccacuggguccgccaggcccccggcaagggccucgagugggucgccgucaucuccuacgacggcuccgacaaguacuacgccgacuccgucaagggccgcuucaccaucucccgcgagaacuccaagaacaugcucuaccuccagaugaacucccuccgcggcgaggacaccgccgucuacuacugcgccaaggaccuccgcgaguucgagugcgaggagugggccuccgacuacuacgacuucggccgcgacuaccccugccaggacccccgcggcgucgucggcaccuucgacgucuggggccacggcucccucgucaccgucuccucc

SEQ ID NO: 17444 - RNA, 432 nt, Artificial Sequence
  derived and/or modified sequence opt2 from anti-HIV_cap256-048-089065_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacggcaccaacaaguacuacgucgacuccgucaagggccgcuucaccaucucccgcgacaacuccaagaacacccucuaccuccagaugaacucccucaccgccgaggacaccgccgucuacuacugcgccaaggaccucggcggcaacaaggacgacgaguggggcaccgacuacuacgacuucuccgucgccuaccccguccaggacccccgcgccgucuccggcaucuucgacgucuggggccacggcaccauggucaccgucuccucc

SEQ ID NO: 17445 - RNA, 432 nt, Artificial Sequence
  derived and/or modified sequence opt2 from anti-HIV_cap256-048-084986_VR-Chain
cagguccagcucgucgaguccggcggcggcgucguccagcccggccgcucccuccgccucuccugcgccgccuccggcuucaccuucuccgacuacgccaugcacuggguccgccaggcccccggcaagggccucgagugggucgcccucaucuccuacgacggcuccaacaaguacuacgccgacuccgucaagggccgcuucaccaucucccgcgacaacuccaagaacacccucuaccuccagauguccucccucaccgccgaggacaccgccgucuacuacugcgccaaggaccucggcggcaacaagaacgacgagugggccaccgacuacuacgaccucuccaucgccuaccccauccacgacccccgcgccguccucggcgccuucgacgucuggggccagggcaccaugcucaccgucuccucc

SEQ ID NO: 17446 - RNA, 432 nt, Artificial Sequence
  derived and/or modified sequence opt2 from anti-HIV_cap256-048-083355_VR-Chain
cagguccagcucgucgaguccggcggcggcgucguccagcccggccgcucccuccgccucuccugcgccgucuccggcuucaucuucuccuccuacgccaugcgcuggguccgccaggcccccggcaagggccucgagugggucgccgucaucuccuacgacggcuccaagaccaacuacgccgacuccgucaagggccgcuucaccaucucccgcgacaacuccaagaacacccucuaccuccagaugaacucccucaccuccgaggacaccgccgucuacuacugcgccaaggaccucggcggcuccaagaccgacgaguggggcaccgacuacuacgaguucuggaacgccuaccccguccaggacccccgcgucgucgucggcgccuucgacaucuggggccacggcaccauggucaccgucuccucc

SEQ ID NO: 17447 - RNA, 432 nt, Artificial Sequence
  derived and/or modified sequence opt2 from anti-HIV_cap256-048-082462_VR-Chain
cagguccaccucgucgaguccggcggcggcgucguccagcccggcaagucccuccgccucuccugcaccgccucccgcuucaucuuccgcaacuacgccauggacuggguccgccaggcccccggcaagggccucgagugggucgccgucaucuccuacgacggcgucaaggagcacuacgccgaguccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17448 - RNA, 432 nt, Artificial Sequence
  derived and/or modified sequence opt2 from anti-HIV_cap256-048-082246_VR-Chain
cagguccaccucgucgaguccggcggcggcgucguccagcccggccgcucccuccgcaucuccugcgccgccuccggcuucaccuucuccaagaacgccaugcacuggguccgccaggcccccggcaagggccucgagugggucgccuucgucgccuucgacgaguccgacaaguacuacgccgacuccgucaagggccgcuucaccaucucccgcgacaacuccaagaacauccucucccuccagaugaacucccuccgcgccgaggacaccgccgucuacuacugcgccaaggaggucgacgaguacaaggacgacgagugggccuccgacuacuacgaccucuccaucgccuaccccguccgcgacccccgcgccgucgucggcggcuucgacaucuggggccagggcaccauggucaccgucuccgcc

SEQ ID NO: 17449 - RNA, 432 nt, Artificial Sequence
  derived and/or modified sequence opt2 from anti-HIV_cap256-048-080752_VR-Chain
cagguccagcucgucgaguccggcggcggcgucguccagcccggcggcucccuccgccucuccugcgccgccuccggcuucaccuucuccaacuacggcaugcacuggguccgccaggcccccggcaagggccucgagugggucgccuucauccgcuacgacggcgacaucaccuacuacgucgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgaguaccccugccaggacccccgcggcgucgucggcaccuucgacaucuggggccagggcaccauggucaccgucuccucc

SEQ ID NO: 17450 - RNA, 435 nt, Artificial Sequence
  derived and/or modified sequence opt2 from anti-HIV_cap256-048-078409_VR-Chain
cagguccagcucgucgaguccggcggcggcgucguccagcccggccgcucccuccgccucuccugcgccgccuccggcuucaccuucaacaacuacgccauggacuggguccgccaggcccccggcaagggccucgagugggucgcccucaucuccuacgacggcuccaacaaguacuacgccgaguccgucaagggccgcuucaccaucucccgcgacaacuccaagaacacccucuaccuccagaugaacucccuccgcgccgaggacaccgccgucuacuacugcgccaaggacgucggcgagaagcaguccaugaugcgcugggccaccgacuacuacgaccucuccaucgccuaccccguccccgacccccgcgccgucgucggcgccuucgaccucuggggccgcggcaccauggucaccgucuccucc

SEQ ID NO: 17451 - RNA, 432 nt, Artificial Sequence
  derived and/or modified sequence opt2 from anti-HIV_cap256-048-078273_VR-Chain
gagguccagcucgucgaguccggcggcggccucguccagcccggcggcucccuccgccucuccugcgccgccuccggcuucaccgucuccuccaacuacauguccuggguccgccaggcccccggcaagggccucgagugggucgccgucaucuccuccgacggcuccaacaagaacuacgccgacuccgucaagggccgcuucaccaucucccgcgacaacuccaagaacacccucuuccuccagaugaacucccuccgccccgaggacaccgccgucuacuucugcgccaaggaccucggcgccaacaaggacgacgagugggccaccgacuacuacgaccucuccaucgccuaccccguccacgacccccgcgccgucgucggcaucuucgaccucuggggccagggcaccauggucaccgucuccucc

SEQ ID NO: 17452 - RNA, 432 nt, Artificial Sequence
  derived and/or modified sequence opt2 from anti-HIV_cap256-048-078062_VR-Chain
gacgucuaccucgucgaguccggcggcggccucguccagcccggcggcucccuccgccucuccugcaccgccuccggcaucaccuucuccaccuacgagaugaacuggguccgccaggcccccggcaagggccucgagugggucgccuucgucgccuucgacggcuccgacaaguacuacgccgacuccgucaagggccgcuucgucaucucccgcgacaacuccaagaacacccucucccuccagaugaacucccuccgcgccgaggacaccgccgucuacuacugcgccaaggaggucggcgaggacaaggacgacgagugggccuccgacuacuacgaccucuccaucgccuaccccguccacgacccccgcgccgucgucggcggcuucgacaucuggggccagggcaccauggucaccgucuccucc

SEQ ID NO: 17453 - RNA, 432 nt, Artificial Sequence
  derived and/or modified sequence opt2 from anti-HIV_cap256-048-077798_VR-Chain
cagguccagcucgucgaguccggcggcggcgucguccagcccggccgcucccuccgccucuccugcgccgccuccggcuucaccuucuccaacuacggcaugcacuggguccgccagacccccggcaagggccucgagugggucgccgucaucuccuacgacggcuccaacaaguucuacgccgacuccgucaagggccgcuucaccaucucccgcgacaacuccaagaacacccucuaccuccagaugaacucccuccgcgucgaggacaccgccgucuaccacugcgccaaggaccucggcggcuccaaguccgacgagugggccaccgacuacuacgacugguccaucgccuaccccguccacgacccccgcgccgucgucggcgucuucgacaucuggggccagggcacccucgucaccgucuccucc

SEQ ID NO: 17454 - RNA, 432 nt, Artificial Sequence
  derived and/or modified sequence opt2 from anti-HIV_cap256-048-073853_VR-Chain
gagguccagcucgucgaguccggcggcggccucgucaagcccggcggcucccuccgccucuccugcgccgccuccggcuucaccuucuccgacgccuggaugaacuggguccgccaggcccccggcaagggccucgagugggucgccggcaucuccuucgccggcaccaacaaguacuacgccgacuccgucaagggccgcuucaccaucucccgcgacaacuccaagaacacccucuaccuccagaugaacucccuccgcgccgaggacaccgcccucuacuacugcgccaaggacaugcgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17455 - RNA, 435 nt, Artificial Sequence
  derived and/or modified sequence opt2 from anti-HIV_cap256-048-071661_VR-Chain
cagguccagcucgucgaguccggcggcggcgucguccagcccggccgcucccucggccucuccugcgaggucuccggcuucaccuucuccgacuacuucauguccuggauccgccaggcccccggcaagggccucgagugggucgccgucaucucccacgacggcaacaacaaguacuaccccgacuccguccagggccgcuucaccaucucccgcgagaacuccaagaacacccucuaccuccagaugaacucccucaagcccgaggacaccgccgucuacuucugcgccaaggaccucggcggcgaguccgaggucgaggagugggccuccgacuacuacgacuucggccgcgacauccccggccccgacccccgcggcgucgucggcacccucgacaucuggggccacggcaccauggucaccgucuccucc

SEQ ID NO: 17456 - RNA, 432 nt, Artificial Sequence
  derived and/or modified sequence opt2 from anti-HIV_cap256-048-071360_VR-Chain
cagguccagcucgucgaguccggcggcggcgucguccagcccggccgcucccuccgccucuccugcgccgccuccggcuucacccucaccaacuacgccauggacuggguccgccaggcccccggcaagggccucgagugggucgccgucaucuccuccgacggcuccaacaagaacuacgaggacuccgucaagggccgcuucaccaucucccgcgacaacuccaagaacacccucuaccuccagauguccucccuccgccccgaggacaccgccgucuacuacugcgccaaggacgucggcgacaacaaguccgacgagugggccaccgacuacuacgacuucuccaucgccuaccccguccccgacccccgcgccgucgucggcgccuucgaccucuggggccagggcaccauggucaccgucuccucc

SEQ ID NO: 17457 - RNA, 432 nt, Artificial Sequence
  derived and/or modified sequence opt2 from anti-HIV_cap256-048-070955_VR-Chain
gagguccagcucgucgaguccggcggcggccucguccagcccggcggcuccguccgccucuccugcgccgucuccggcuucaccuucuccuccuacuggauguccuggguccgccaggcccccggcaagggccucgagugggucgccgucaucuccgacuccggcuccaacaaguacuacgccgacuccgucaagggccgcuucaccaucucccgcgacaacuccaagaacacccucuaccuccagaugaacucccuccgcgccgaggacaccgccgucuacuucugcgccaaggaccucggcggccgcgagaccgaggagugggccuccgacuacuacgacuucggccgcgacuuccccggccaggaccagcgcgccgucgccggcgucuucgacauguggggccagggcaccauggucaccgucuccucc

SEQ ID NO: 17458 - RNA, 432 nt, Artificial Sequence
  derived and/or modified sequence opt2 from anti-HIV_cap256-048-070061_VR-Chain
gagguccagcuccucgaguccggcggcggccucguccagcccggcggcucccuccgccucuccugcgccgccuccggcuucaccuucuccuccuacgccaugcacuggguccgccaggcccccggcaagggccucgagugggucgccgucaccuccuacgacggcuccaacaaguacuacgccgacuccgucaagggccgcuucaccaucucccgcgacaacuccaagaacacccucuacaugcagaugaacucccuccgcgccgaggacaccgccgucuacuacugcgccaaggaccagggcgaguccgagaaggaggagugggccuccgacuacuacgacuucggccgcgacuaccccggccgcgacccccgccgcgucgucgccaccuucgccaucuggggccagggcaccauggucaccgucuccucc

SEQ ID NO: 17459 - RNA, 432 nt, Artificial Sequence
  derived and/or modified sequence opt2 from anti-HIV_cap256-048-069669_VR-Chain
cagguccagcucgucgaguccggcggcggcgucguccagcccggccgcucccuccgccucuccugcgccgucuccggcuucaccuucuccaaguuccccaugcacuggguccgccaggcccccggcaagggccucgagugggucgccgucaucuccuacgacggcaacaagaaguacuacgucgacuccgccaagggccgcuucaccaucucccgcgacaacucccgcaagacccucuaccuccagaugaccggccuccgccccgaggacaccgccgucuacuacugcgccaaggaccucggcggcggcgagugcgagaccugggccuccgacuacuacgacuucggcaaggacuaccccugccucgacccccgcgacgucgucggcaccuucgacaucuggggccagggcacccucgucaccgucuccucc

SEQ ID NO: 17460 - RNA, 432 nt, Artificial Sequence
  derived and/or modified sequence opt2 from anti-HIV_cap256-048-069205_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgucgucaucuccaacgacggcaacaacaaguacuacgccgacuccgucaagggccgcuucaccaucucccgcgacaacuccaagaacaccgucuaccuccagaugaacucccuccgcgccgaggacaccgccgucuacuacugcgccaaggacgucggcgacaccaagaaggacgagugggccaccgacuacuacgaccucuccaucgccuaccccguccaggacccccaggccgucgucggcgccuucgacaucuggggccagggcaccauggucaccgucuccucc

SEQ ID NO: 17461 - RNA, 432 nt, Artificial Sequence
  derived and/or modified sequence opt2 from anti-HIV_cap256-048-068882_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacggcaccgacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaccgccuaccccgucgagcacccccgcgccgucgucggcgucuucgacaucuggggccagggcaccaaggucaccgucuccucc

SEQ ID NO: 17462 - RNA, 432 nt, Artificial Sequence
  derived and/or modified sequence opt2 from anti-HIV_cap256-048-067764_VR-Chain
gagguccagcucguccaguccggcggcggccucgucaagcccggcggcucccuccgccucuccugcgccgccuccggcuucaccuucuccaccuacuccaugaacuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17463 - RNA, 432 nt, Artificial Sequence
  derived and/or modified sequence opt2 from anti-HIV_cap256-048-066845_VR-Chain
cagguccuccucgucgaguccggcggcggcgucguccagcccggcggcucccucacccucuccugcgccgccuccggcuucaccuucuccaacuacggcaugcacuggguccgccaggcccccggcaagggccucgagugggucgccuucauccgcuacgacggcaacaacaaguacuacgccgacuccgucaagggccgcuucaccaucucccgcgacaacuccaaggacacccucuaccuccagauggacggccuccgccccgaggacaccgcccucuacuacugcgccaaggaccucggcgagcgcgagugcgaggagugggccuccaacuacuacgacuucggccgcgacuaccccugccaggacccccgcggcgucgucggcaccuucgacaucuggggccagggcaccauggucaccgucuccucc

SEQ ID NO: 17464 - RNA, 432 nt, Artificial Sequence
  derived and/or modified sequence opt2 from anti-HIV_cap256-048-065226_VR-Chain
gagguccagcucgucgaguccggcggcggccucgucaagcccggcggcucccuccgccucuccugcgucgccuccggcuucaccuucuccaacuacggcaugcacuggguccgccaggcccccggcaagggccucgucugggucgccggcaucuccuucgccggcaccaacaaguacuacgccgccuccgucaagggccgcuucaccaucucccgcgacaacuccaagaacacccucuaccuccagaugaacucccuccgcgccgaggacaccgcccucuacuacugcgccaaggacaugcgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17465 - RNA, 432 nt, Artificial Sequence
  derived and/or modified sequence opt2 from anti-HIV_cap256-048-063717_VR-Chain
cagguccagcucgucgaguccggcggcggcgucguccagcccggccgcucccuccgccucuccugcgccgccuccggcuucuccuucuccaaccacgccauggacuggguccgccaggcccccggcaagggccucgagugggucgccgucaucuccuccgacggcuccgacaagaucuacgccgaguccgucaagggccgcuucaccaucucccgcgacaacuccaagaacacccucuaccuccagaugaacucccuccgcgucgaggacaccgccgucuacuucugcgccaaggaccucggcgccaacaaggacgacgagugggccaccgacuacuacgaccucuccaucgccuaccccguccccgacccccgcgccgucgucggcgccuucgacaucuggggccagggcaccauggucuccgucuccucc

SEQ ID NO: 17466 - RNA, 432 nt, Artificial Sequence
  derived and/or modified sequence opt2 from anti-HIV_cap256-048-063150_VR-Chain
gagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgcccacauccgcuacgacggcuccaacaaguacuacaucgacuccguccagggccgcuucaccaucucccgcgacaaccccaagaacacccucuaccuccagaugaacucccuccgcaccgaggacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17467 - RNA, 432 nt, Artificial Sequence
  derived and/or modified sequence opt2 from anti-HIV_cap256-048-062431_VR-Chain
cagguccagcucgucgaguccggcggcggcgucguccagcccggccgcucccuccgccucuccugcgccgccuccggcuucaccuucuccaacuucgccauggacuggguccgccaggcccccggcaagggccucgagugggucgccgucaucuccuccgacggcuccaagaagaacuacggcgacuccgucaagggccgcuucaccaucucccgcgacaacuccaagaacacccucuuccuccagaugaacucccuccgccccgaggacaccgcccucuacuacugcgccaaggaccucggcggcuacaaguccgacgagugggccaccgacuacuacgaccucuccaucgccuaccccguccaggacccccgccccuggcucgagcuccucuacaucuggggccagggcgccauggucaccgucuccucc

SEQ ID NO: 17468 - RNA, 432 nt, Artificial Sequence
  derived and/or modified sequence opt2 from anti-HIV_cap256-048-060745_VR-Chain
cagguccagcucgucgaguccggcggcuccgucguccagcccggccgcucccuccgccucaccugcaccgccuccggcuucaccuucucccacuacgccauggacuggguccgccaggcccccggcaagggccucgagugggucgccgucaucuccuccgacgccaccaacaagaacuacgccgacuccgucaagggccgcuucaccaucucccgcgacaacuccaagaacaccgucuaccuccagauggacucccuccgcgccgaggacaccgccgucuacuacugcgccaaggacgucggcgacuacaaggacgacgagugggccaccgacuacuacgacuucuccaucgccuaccccguccccgacccccgcgccgucgucggcgccuucgacuucuggggccagggcaccauggucaccgucuccucc

SEQ ID NO: 17469 - RNA, 432 nt, Artificial Sequence
  derived and/or modified sequence opt2 from anti-HIV_cap256-048-060420_VR-Chain
cagguccagcucgucgaguccggcggcggcgucguccagcccggccgcucccuccgccucuccugcgccgccuccggcuucaccuucuccuccuacggcauggccuggguccgccaggcccccggcaagggccucgagugggucaccgucaucuccuucgccggcgucaagaaguacuacgccgacuccgucaagggccgcuucaccaucucccgcgacaacuccaagggcacccucuaccuccagaugaacucccuccgcgccgaggacaccgccgucuacuacugcgccaaggacgucggcgacaccaagaaggacgagugggccaccgacuacuacgaccucuccaucgccuaccccguccaggacccccaggccgucgucggcgccuucgacaucuggggccagggcaccauggucaccgucuccucc

SEQ ID NO: 17470 - RNA, 435 nt, Artificial Sequence
  derived and/or modified sequence opt2 from anti-HIV_cap256-048-060014_VR-Chain
cagguccagcucgucgaguccggcggcggcgucguccagcccggccgcucccuccgccucuccugcgccgccuccggcuucaccuucuccaacuacggcaugcacuggguccgccaggcccccggcaagggccucgagugggucgcccucaucucccacgacggcuccaacaagaacuucgccgacuccgucaagggccgcuucaccaucucccgcgacaacuccaagaacacccucuaccuccagaugaacucccuccgcaccgaggacaccgccaucuacuacugcgccaaggaccucggcggcgaguccgagaucgaggaguggcccuccgacuacuacgacuucggccgcgacuaccccguccccgacccccgcggcgucgucggcaccuucgacuucuggggccagggcaccauggucaccgucuccucc

SEQ ID NO: 17471 - RNA, 432 nt, Artificial Sequence
  derived and/or modified sequence opt2 from anti-HIV_cap256-048-059747_VR-Chain
cagguccagcucgucgaguccggcggcggcgucguccagcccggccgcucccuccgccucuccugcgccgccuccggcuucaccuucacccacuacgccauggacuggguccgccaggcccccggcaagggccucgagugggucgccgucaucuccuccgacggcuccuccaaggacuacgccgacuccgucaagggccgcuucaccaucucccgcgacaacuccaagaacacccucucccuccagaugaacucccuccgccccgaggacaccgccgucuacuacugcgccaaggaccucggcgccuccaaggacgacgagugggccaccgacuacuacgaccucuccaucgccuaccccguccacgacccccgcgccgucgucggcggcuucgacaucuggggccagggcaccauggucaccgucuccucc

SEQ ID NO: 17472 - RNA, 432 nt, Artificial Sequence
  derived and/or modified sequence opt2 from anti-HIV_cap256-048-058393_VR-Chain
cagguccagcucgucgaguccggcggcggcgucguccagcccggcggcucccuccgccucuccugcgccgccuccggcuucaccuucaacaccuacggcaugcacuggguccgccaggcccccggcaagggccucgagugggucaccuucauccgcuacgacggcuccaacgaguacuacgccgacuccgucaagggccgcuucaccaucucccgcgacaacuccaagaacacccucuaccuccagaugaacucccucuccgucgaggacaccgccgucuacuacugcgccaaggaccucggcaagaacaaggacgacgagugggccaccgacuacuacgacaucuccaucgccuaccccguccccgacccccgcgccgucgucggcgucuucgacaucuggggccagggcaccgucgucaccgucuccucc

SEQ ID NO: 17473 - RNA, 432 nt, Artificial Sequence
  derived and/or modified sequence opt2 from anti-HIV_cap256-048-058159_VR-Chain
cagguccagcucgucgaguccggcggcggcgucguccagcccggccgcucccuccgccucuccugcgccgccuccggcuucaccuucuccuccuaccccaugcacuggguccgccaggcccccggcaagggccucgagugggucgccgucaucuccuucgccggcaccaacaaguacuacgcccacuccgucaagggccgcuucaccaucucccgcgacaacuccaagaacacccucuaccuccagaugaacucccuccgcgccgaggacaccgcccucuacuacugcgcccgcgaccuccgcgaguccgagugcgaggagugggccuccgacuacuacgacuucggccgcgaguaccccugccaggacccccgcggcgucgucggcaccuucgacaucuggggccgcggcaccauggucaccgucuccucc

SEQ ID NO: 17474 - RNA, 432 nt, Artificial Sequence
  derived and/or modified sequence opt2 from anti-HIV_cap256-048-057127_VR-Chain
gacgucuaccucgucgaguccggcggcggccucguccagcccggcggcucccuccgccucuccugcgucgccuccggcaucaccuucuccuccuacggcaugcacuggguccgccaggcccccggcaagggccucgagugggccgccuucauccgcuacgacggccgcaacaaguacuacgccgacuccgucaagggccgcuucaccaucucccgcgacaacuccaagaacacccucucccuccagaugaacaaccuccgcgccgaggacaccgccgucuacuacugcgccaaggaggucggcgacaacaaggacgacgagugggccuccgacuacuacgaccucuccaucgccuaccccguccaggacccccgcgccgucgucggcggcuacgacaucuggggccagggcaccauggucaccgucuccucc

SEQ ID NO: 17475 - RNA, 432 nt, Artificial Sequence
  derived and/or modified sequence opt2 from anti-HIV_cap256-048-056251_VR-Chain
gagguccagcucgucgaguccggcggcggccucguccagcccggccgcucccuccgccucuccugcgccggcuccggcuucaccuucuccaacuucggcuuccacuggguccgccaggcccccggcaagggccucgagugggucgccgccaucuccuucgccggcuacaacaaguacuacgccgacuccgucaagggccgcuucaccaucucccgcgagaacuccaacaacaugcucuaccuccagauguccucccuccgcgccgaggacaccgccgucuacuacugcgccaaggaccuccgcgaguccgagugcgaggagugggccuccgacuacuacgacuucggcaaggacuaccccugccaggacccccgcggcgucgucggcaccuucgacgucuggggccacggcucccucgucaccgucuccucc

SEQ ID NO: 17476 - RNA, 432 nt, Artificial Sequence
  derived and/or modified sequence opt2 from anti-HIV_cap256-048-055421_VR-Chain
cagguccagcucgucgaguccggcggcggcgucguccagcccgcccgcucccuccgccucuccugcgccgccuccggcuucaucuucuccaccuacggcaugcacuggguccgccaggcccccggcaagggccucgagugggucgccgucaucuccuccgacggcuccuccaaggacuacgccgacuccgucaagggccgcuucaccaucucccgcgacaacuccaagaacacccucucccuccagaugaacucccuccgccccgaggacaccgccgucuacuacugcgccaaggaccucggcgccuccaaggacgacgagugggccaccgacuacuacgacuucuccaucgccuaccccguccaggacccccgcgccgucgucggcgccuucgacaucuggggccagggcaccauggucaccgucuccucc

SEQ ID NO: 17477 - RNA, 432 nt, Artificial Sequence
  derived and/or modified sequence opt2 from anti-HIV_cap256-048-054989_VR-Chain
cagguccagcucgucgaguccggcggcggcgucguccagcccggcggcucccuccgccucuccugcgccgccuccggcuucaccuucuccaccaacggcaugcacuggguccgccaggcccccggcaagggccucgagugggucgccuucauccgcuacgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17478 - RNA, 435 nt, Artificial Sequence
  derived and/or modified sequence opt2 from anti-HIV_cap256-048-054759_VR-Chain
cagguccagcucgucgaguccggcggcggcgucguccagcccggccgcucccuccgccucuccugcgccgccuccggcuucuccuucuccaagaacggcaugcacuggguccgccaggcccccggcaagggccucgagugggucgccuucgucgccuucgacgaguccgacaaguacuacgccgacuccgucaagggccgcuucaccaucucccgcgacaacuccaagaacacccucucccuccagaugaacucccuccgcgucgaggacaccgccgucuacuacugcgccaaggaggucggcgagaacaaggacgacgagugggccgcccccgacuacuacgacuucuccaucgccuaccccguccaggacccccgcgccgucgucggcggcuucgacaucuggggccagggcaccauggucaccgucuccucc

SEQ ID NO: 17479 - RNA, 432 nt, Artificial Sequence
  derived and/or modified sequence opt2 from anti-HIV_cap256-048-052573_VR-Chain
caggucaagcucgucgaguccggcggcggcgucguccagcccggccgcucccuccgccucuccugcgccgccuccggcuucuccuucuccaacuacgccauggacuggguccgccaggcccccggcaagggccucgagugggucgccgucgucuccuccgacggcuccaacaagaacuacgccgacuccgucaagggccgcuucaccaucucccgcgacaacuccaagaacaccgucuaccuccagaugaacucccuccgcgccgaggacaccgccgucuacuacugcgccaaggaccucggcgccaacaaggacgacgagugggccaccgacuacuacgacugguccaucgccuaccccguccacgacccccgcgccgucgucggcgucuucgacaucuggggccagggcacccucgucaccgucuccucc

SEQ ID NO: 17480 - RNA, 432 nt, Artificial Sequence
  derived and/or modified sequence opt2 from anti-HIV_cap256-048-051477_VR-Chain
caggagcagcucgucgaguccggcggcggcgucguccagcccggccgcucccuccgccucuccugcgccgccuccggcuucaccuucuccaacuacgccaugcacuggguccgccaggcccccggcaagggccucgagugggucgccgccaugucccacgacggcuccgacaaguacuacgccgacuccgucaagggccgcuucaccaucucccgcgacaacuccaagaacacccucuacaugcagaugaacucccuccgcgccgaggacaccgccgucuacuacugcgccaaggaccagggcgaguccgagaaggaggagugggccuccgacuacuacgaccucuccaucgccuaccccauccaggacccccgcgccauggucggcgccuucgacaucuggggccagggcaccauggucaccgucuccucc

SEQ ID NO: 17481 - RNA, 432 nt, Artificial Sequence
  derived and/or modified sequence opt2 from anti-HIV_cap256-048-051299_VR-Chain
cagguccagcucgucgaguccggcggcggcgucguccagcccggccgcucccuccgccucuccugcgccgccuccggcuucaccuucuccaccuucggcaugcacuggguccgccaggcccccggcaagggccucgagugggucgcccucaucucccacgacggcaacaacaaguacuacgccgacucccucaagggccgcuucaccaucucccgcgagaacuccaagaacacccucuuccuccagaugaacucccuccgcgccgaggacaccuccgucuacuacugcgccaaggaccucggcgacuccgagugcgaggagugggccuccgacuacuacgacuucggcaaggacuaccccugccuccacccccgcggcgucgucggcaccuucgacuucuggggccacggcaccauggucaccgucuccucc

SEQ ID NO: 17482 - RNA, 432 nt, Artificial Sequence
  derived and/or modified sequence opt2 from anti-HIV_cap256-048-050815_VR-Chain
cagguccagcucgucgaguccggcggcggcgucguccagcccggcggcucccuccgccucuccugcgucgucuccggcuucaccuucuccuccuacggcaugcacuggguccgccaggcccccggcaagggccucgagugggucuccuucauccgcuucgacggcaacuacgaguacuacgucgacuccgucaagggccgcuucaccaucucccgcgacaacuccaagaacaccgucuaccuccagauggacucccuccgcgccgaggacaccgccgucuacuacugcgccaaggacgucggcgacuacaaggacgacgagugggccaccgacuacuacgacuucuccaucgccuaccccguccccgacccccgcgccgucgucggcgccuucgacuucuggggccagggcaccauggucaccgucuccucc

SEQ ID NO: 17483 - RNA, 432 nt, Artificial Sequence
  derived and/or modified sequence opt2 from anti-HIV_cap256-048-049884_VR-Chain
cagguccagcucgucgaguccggcggcggcgucguccagcccggccgcucccuccgccucuccugcgccgccuccggcuucuccuucaacaccuacgccaugcacuggguccgccaggcccccggcaagggccucgaguggauggcccucaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgccaaggaccucggcggcaacaaggacgacgagugggccaccgacuacuacgaccucuccaucgccuaccccguccaggacccccgcgucgucgucggcaucuucgacaucuggggccagggcaccauggucaccgucuccucc

SEQ ID NO: 17484 - RNA, 432 nt, Artificial Sequence
  derived and/or modified sequence opt2 from anti-HIV_cap256-048-049170_VR-Chain
cagguccagcucgucgaguccggcggcggcgucguccagcccggccgcucccuccgccucuccugcgccgccuccggcuucaucuucuccuccuacggcaugcacuggguccgccaggcccccggcaagggccucgagugggucgccgucaucuccggcgacggcaccaagaaggacuucgccgacuccgucaagggccgcuucaccaucuccaaggacaacuccaagaacauggucucccuccagaugaacucccuccgcgccgaggacgccgccgucuacuacugcgccaaggaccucggcgaguccgacaacgaggaguggcccuccgacuacuacgacuucggccgcgacuucaccggccagaacccccgcgccgucgucggcaccuucgaccucuggggccagggcaccauggucaccgucuccucc

SEQ ID NO: 17485 - RNA, 435 nt, Artificial Sequence
  derived and/or modified sequence opt2 from anti-HIV_cap256-048-048531_VR-Chain
cagguccagcucgucgaguccggcggcggcgucguccagcccggccgcucccuccgccucuccugcgccgccuccggcuucaccuucuccuccuacggccuccacuggguccgccaggcccccggcaagggccucgagugggucgccuucaucuccuacgacggcaacaacaagcacuacgucgacuccgucaagggccgcuucaccaucucccgcgacaacuccaagaacacccucuaccuccagaugaacucccuccgcgccgaggacaccgccgucuacuacugcgccaaggaccucggcggcgaguccgagaucgaggagugggccaccgacuacuacgacuucuccaucgccuaccccgucaaggagucccgcggcgucgucggcaucuucgacauguggggccagggcaccauggucaccgucuccucc

SEQ ID NO: 17486 - RNA, 432 nt, Artificial Sequence
  derived and/or modified sequence opt2 from anti-HIV_cap256-048-048259_VR-Chain
cagguccagcucgucgaguccggcggcggcgucguccagcccggccgcucccuccgccucuccugcgccgccuccggcuucaccuucuccaccugcgccaugcacuggguccgccaggcccccggcaagggccucgagugggucgccgucaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgccaaggaggucgacaucaacaaggaggacgagugggccuccgacuacuacgacuucuccaucgccuaccccguccaggacccccgcgccgucgucggcggcuucgacaucuggggccagggcaccauggucaccgucuccucc

SEQ ID NO: 17487 - RNA, 432 nt, Artificial Sequence
  derived and/or modified sequence opt2 from anti-HIV_cap256-048-047313_VR-Chain
cagguccagcucgucgaguccggcggcggcgucguccagcccggccgcucccuccgccucuccugcgccgccuccggcuucaccuucuccaccuucggcaugcacuggguccgccaggcccccggcaagggccucgagugggucgccgucaucucccacgacggcaacaacaaguacuacgccgacuccgucaagggccgcuucaccaucucccgcgacaacuccaagaacaccgucuaccuccagaugaacucccuccgcgccgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17488 - RNA, 432 nt, Artificial Sequence
  derived and/or modified sequence opt2 from anti-HIV_cap256-048-046596_VR-Chain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucaugcgcuucgacggcuccaaccgcuacuacggcgacuccgucaagggccgcuucaccaucucccgcgacaacuccaagaacacccucuaccuccagaugaacucccuccgcaccgaggacgccgcccucuacuacugcgccaaggacaugcgcgaguucgagugcgaggagugggccuccgacuacuacgacuucggccgcgacuaccccugccaggacccccgcggcgucgucggcaucuucgacaucuggggccagggcaccauggucaccgucuccucc

SEQ ID NO: 17489 - RNA, 432 nt, Artificial Sequence
  derived and/or modified sequence opt2 from anti-HIV_cap256-048-044781_VR-Chain
cagguccagcucgucgaguccggcggcggcgucguccagcccggccgcucccuccgccucuccugcgccgccuccggcuucaccuucaccuccuacgccauccacuggguccgccaggcccccggcaagggccucgagugggucgccgucaucuccuacgacggcuccaagaagaacuacgccgacuccgucaagggccgcuucaccaucucccgcgacaacuccaagaacacccucuacguccagaugaacucccuccgcgccgaggacaccgccgucuacuacugcgccaaggaggucggcgaggacaaggacgacgagugggccuccgacuacuacgaccucuccaucgccuaccccguccacgacccccgcgccgucgucggcggcuucgacaucuggggccagggcaccauggucaccgucuccucc

SEQ ID NO: 17490 - RNA, 432 nt, Artificial Sequence
  derived and/or modified sequence opt2 from anti-HIV_cap256-048-042599_VR-Chain
cagguccagcucgucgaguccggcggcggcgucguccagcccggccgcucccuccgccucuccugcgccgccuccggcuucaccuucuccaacuacggcaugcacuggguccgccagacccccggcaagggccucgagugggucgccgucaucuccuacgacggcuccaacaaguucuacgccgacuccgucaagggccgcuucaccaucucccgcgacaacuccaagaacacccucuaccuccagauguccucccuccgcgccgacgacaccgccgucuacuacugcgccaaggaggucggcgaggacaaggacgacgagugggccuccgacuacuacgaccucuccaucgccuaccccguccacgacccccgcgccgucgucggcggcuucgacaucuggggccagggcaccauggucaccgucuccucc

SEQ ID NO: 17491 - RNA, 432 nt, Artificial Sequence
  derived and/or modified sequence opt2 from anti-HIV_cap256-048-041276_VR-Chain
cagguccagcucgucgaguccggcggcggcgucguccagcccggccgcucccuccgccucuccugcgccgccucccgcuucaccuucuccuccuacgccaugcacuggguccgccaggcccccggcaagggccucgagugggucgccaucaucuccuacgacggcuccaacaaguacuacgccgacuccgucaagggccgcuucaccaucucccgcgacaacuccaagaacacccucuuccuccagaugaacucccuccgcgccgaggacaccgcccucuacuacugcgccaaggaccucggcggcuacaaguccgacgagugggccaccgacuacuacgaccucuccaucgccuaccccauccaggacccccgcgccgucgucggcgccuucgacaucuggggccagggcaccauggucaccgucuccucc

SEQ ID NO: 17492 - RNA, 432 nt, Artificial Sequence
  derived and/or modified sequence opt2 from anti-HIV_cap256-048-040200_VR-Chain
cagguccagcucgucgaguccggcggcggcgucguccagcccggccgcucccuccgccucuccugcgucgccuccggcuucaccuucuccuccuucggcaugcacuggguccgccaggcccccggcaagggccucgagugggucgccgucaucucccacgacggccacaacaaguacuacgccgacucccucaagggccgcuucaccgucucccgcgagaacuccaagaacacccucuuccuccagaugaacucccuccgcgccgaggacaccuccgucuacuacugcgccaaggaccucggcggcggcgagugcgaggagugggccuccgacuacuacgacuucggccgcgacuaccccugccucaccccccgcggcgucgucggcaccuucgacaucuggggccacggcaccaccgucaccgucuccucc

SEQ ID NO: 17493 - RNA, 432 nt, Artificial Sequence
  derived and/or modified sequence opt2 from anti-HIV_cap256-048-039061_VR-Chain
gagguccagcuccucggcuccggcggcggccucguccagcccggcggcucccuccgccucaccugcgccgucuccggcuucaccuucuccuccuucgccauguccuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccaucuaccacugcgccaaggaccucggcggcaccaaguccgacgagugggccaccgacuacuacgaccucuccaucgccuaccccauccaggaccccggcgccgucgucggcgucuucgacaucuggggccagggcaccauggucaccgucuccucc

SEQ ID NO: 17494 - RNA, 432 nt, Artificial Sequence
  derived and/or modified sequence opt2 from anti-HIV_cap256-048-038515_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgucgucaucuccuacgacggcuccaacaaguacuacgccgacuccgucaagggccgcuucaccaucucccgcgacaacuccaagaacacccucuuccuccagaugaacucccuccgcgccgaggacaccgcccucuacuacugcgccaaggacgucggcgaguacaaguccgacgagugggccaccgacuacuacgaccucuccaucgccuaccccauccaggacccccgcgccauggucggcgccuucgacaucuggggccagggcaccauggucaccgucuccucc

SEQ ID NO: 17495 - RNA, 432 nt, Artificial Sequence
  derived and/or modified sequence opt2 from anti-HIV_cap256-048-038255_VR-Chain
cagguccagcucgucgaguccggcggcggcgucguccagcccggccgcucccuccgccucuccugcgccgccuccggcuucacccucuccuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguacgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17496 - RNA, 432 nt, Artificial Sequence
  derived and/or modified sequence opt2 from anti-HIV_cap256-048-038177_VR-Chain
cagguccagcucgucgaguccggcggcggcgucguccagcccggccgcucccuccgccucuccugcgccgccuccggcuucaccuucaacaccuacggcauccacuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccaucuaccacugcgccaaggaccucggcggcaccaaguccgacgagugggccaccgacuacuacgaccucuccaucgccuaccccauccaggaccccggcgccgucgucggcgucuucgacaucuggggccagggcaccauggucaccgucuccucc

SEQ ID NO: 17497 - RNA, 432 nt, Artificial Sequence
  derived and/or modified sequence opt2 from anti-HIV_cap256-048-035513_VR-Chain
cagguccagcucgucgaguccggcggcggcgucguccagcccggccgcucccuccgccucuccugcgccgccuccggcuucaccuucuccuccuacggcauggccuggguccgccaggcccccggcaagggccucgagugggucaccgucaucuccuucgccggcgucaagaaguacuacgccgacuccgucaagggccgcuucaccaucucccgcgacaacuccaagggcacccucuaccuccagauggacggccuccgccccgaggacaccgcccucuacuacugcgccaaggaccucggcgagcgcgagugcgaggagugggccuccgacuacuacgacuucggccgcgacuuccccugccaggacccccgcggcgucgucggcaccuucgacaucuggggccagggcaccauggucaccgucuccucc

SEQ ID NO: 17498 - RNA, 432 nt, Artificial Sequence
  derived and/or modified sequence opt2 from anti-HIV_cap256-048-034112_VR-Chain
cagaugcagcucgucgaguccggcggcggcgucguccagcccggccgcucccuccgccucuccugcgccgccuccggcuucaccuucaacuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17499 - RNA, 432 nt, Artificial Sequence
  derived and/or modified sequence opt2 from anti-HIV_cap256-048-033983_VR-Chain
cagguccagcucgucgaguccggcggcggcgucguccagcccggcgagucccuccgccucuccugcgccgccuccggcuucacccucuccucccacggcauccacuggguccgccaggcccccggcaagggccucgagugggucgccuucaucuccuccgacggcuccaacaagaacuacggcgacuccgucaagggccgcuucaccaucucccgcgacaacuccaagaacacccucuuccuccagaugaacucccuccgcgccgaggacaccgcccucuacuacugcgccaaggacgucggcgaguacaaguccgacgagugggccaccgacuacuacgaccucuccaucgccuaccccauccaggacccccgcgccauggucggcgccuucgacaucuggggccagggcaccauggucaccgucuccucc

SEQ ID NO: 17500 - RNA, 432 nt, Artificial Sequence
  derived and/or modified sequence opt2 from anti-HIV_cap256-048-032688_VR-Chain
cagguccagcucgucgaguccggcggcggcgucguccagcccggccgcucccuccgccucuccugcgccgccuccggcuucaucuucaacuccuacggcaugcacuggguccgccaggcccccggcaagggccucgagugggucgccgucguccacggcgacggcggcaacaaguacuacgccgacuccgucaagggccgcuucaccaucucccgcgacaacuccaagaacacccucuaccucgagaugaacucccuccgcgccgaggacaccgccgaguacuacugcgccaaggaccucggcgaguccgacaaggaggaguggcccuccgacuacuacgacuucggccgcgacuucaccggccaggucccccgcgccgucgucggcgccuucgacaucuggggccagggcaccauggucaccgucuccucc

SEQ ID NO: 17501 - RNA, 432 nt, Artificial Sequence
  derived and/or modified sequence opt2 from anti-HIV_cap256-048-031092_VR-Chain
cagguccagcucgucgaguccggcggcggcgucguccagcccggccgcucccuccgccucuccugcgccgccuccggcuucuccuucuacaacuucgccauggacuggguccgccaggcccccggcaagggccucgagugggucgccgucaucuccuccgacggcggcaacaagaacuacgucgacuccgucaagggccgcuucaccaucucccgcgacaacuccaagaacacccucuaccuccagaugaacucccuccgcgccgaggacaccgccgucuacuacugcgccaaggaccucggcggcaccaaggacgacgagugggccaccgacuacuacgacaucuccaucgccuaccccguccaggacccccgcgccgucgccggcgccuucgacaucuggggccagggcaccauggucaccgucuccucc

SEQ ID NO: 17502 - RNA, 435 nt, Artificial Sequence
  derived and/or modified sequence opt2 from anti-HIV_cap256-048-030464_VR-Chain
cagguccagcucgucgaguccggcggcggccucgucaagcccggcggcucccuccgccucuccugcgaggccuccggcuucuccuucaccaacuacuacauguccuggauccgccaggcccccggcaagggccucgagugggucgccgucaucuccuucaacggccgcaacaaguacuacgccgacuucgucaagggccgcuucaccaucucccgcgacaacuccaagaacacccucucccuccagaugaacucccuccgcgucgaggacaccgccgucuacuacugcgccaaggaggucggcgagaacaaggacgacgagugggccgcccccgacuacuacgacuucuccaucgccuaccccguccaggacccccgcgccgucgucggcggcuucgacaucuggggccagggcaccauggucaccgucuccucc

SEQ ID NO: 17503 - RNA, 432 nt, Artificial Sequence
  derived and/or modified sequence opt2 from anti-HIV_cap256-048-030289_VR-Chain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17504 - RNA, 432 nt, Artificial Sequence
  derived and/or modified sequence opt2 from anti-HIV_cap256-048-030261_VR-Chain
cagguccagcucgucgaguccggcggcggcgucguccagcccggcggcucccuccgccucuccugcgccgccuccggcuucaccuucuccaccuucggcaugcacuggguccgccaggcccccggcaagggccucgagugggucgccgucaucucccacgacggcuccaacaaguacuacgccgacucccucaagggccgcuucaccaucucccgcgagaacuccaagaacacccucuaccuccagaugaacucccuccgccucgaggacaccgccgucuaccacugcgccaaggaccucggcggcuccaaguccgacgagugggccaccgacuacuacgaccucuccgucgccuaccccguccaggacccccgcgccgucgucggcgucuucgacaucuggggccagggcaccauggucaccgucuccucc

SEQ ID NO: 17505 - RNA, 432 nt, Artificial Sequence
  derived and/or modified sequence opt2 from anti-HIV_cap256-048-029362_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccggcaucuccuucgccggcaccaacaaguacuacgccgacuccgucaagggccgcuucaccaucucccgcgacaacuccaagaacacccucuaccuccagaugaacucccuccgcaccgaggacgccgcccucuacuacugcgccaaggacaugcgcgaguucgagugcgaggagugggccuccgacuacuacgacuucggccgcgacuaccccugccaggacccccgcggcgucgucggcaucuucgacaucuggggccagggcaccauggucaccgucuccucc

SEQ ID NO: 17506 - RNA, 432 nt, Artificial Sequence
  derived and/or modified sequence opt2 from anti-HIV_cap256-048-027638_VR-Chain
cagguccagcucgucgaguccggcggcggcgucguccagcccggccgcucccuccgccucuccugcgucgccuccggcuucaucuucuccuccuacggcauccacuggguccgccaggcccccggcaagggccucgagugggucgccgucaucuccggcgacggcaccaacaaguacugcgccgacuccgucaagggccgcuucaccaucucccgcgacaacuccaagaacaccgucuuccuccagaugaacucccuccgcgccgaggacaccgccgucuucuacugcgccaaggaccucggcgaguccgacaaggaggaguggcccuccgacuacuacgacuucggccgcgacuucaccggccaggucccccgcgccgucgucggcgccuucgacaucuggggccagggcaccauggucaccgucuccucc

SEQ ID NO: 17507 - RNA, 432 nt, Artificial Sequence
  derived and/or modified sequence opt2 from anti-HIV_cap256-048-027613_VR-Chain
guccagcagcucgucgaguccggcggcgacgucguccagcccggcaccucccuccgccucuccugcgaggccuccggccucauccucuccggcuacggccuccacuggguccgccaggcccccggcaagggcauggagugggucgccgucaucuccuacgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaccgccuaccccgucgagcacccccgcgccgucgucggcgucuucgacaucuggggccagggcaccaaggucaccgucuccucc

SEQ ID NO: 17508 - RNA, 432 nt, Artificial Sequence
  derived and/or modified sequence opt2 from anti-HIV_cap256-048-026627_VR-Chain
cagguccagcuccucggcuccggcggcggcuccguccagcccggcggcucccuccgccucaccugcgccgucuccggcuucaccuucuccuccuucgccauguccuggguccgccaggcccccggcaagggccucgagugggucgccuucaucuccuccgacggcaccaacaagaacuacggcgacuccgucaagggccgcuucaccaucucccgcgacaacuccaagaacacccucuuccuccagaugaacucccuccgcgccgaggacaccgcccucuacuacugcgccaaggaccucggcggcuacaaguccgacgagugggccaccgacuacuacgaccucuccaucgccuaccccauccaggacccccgcgccgucgucggcgccuucgacaucuggggccagggcaccauggucaccgucuccucc

SEQ ID NO: 17509 - RNA, 432 nt, Artificial Sequence
  derived and/or modified sequence opt2 from anti-HIV_cap256-048-026239_VR-Chain
cagaugcagcucgucgaguccggcggcggcgucguccagcccggccgcucccuccgccucuccugcgccgccuccggcuucaccuucaacuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcaccgaggacgccgcccucuacuacugcgccaaggacaugcgcgaguucgagugcgaggagugggccuccgacuacuacgacuucggccgcgacuaccccugccaggacccccgcggcgucgucggcaucuucgacaucuggggccagggcaccauggucaccgucuccucc

SEQ ID NO: 17510 - RNA, 432 nt, Artificial Sequence
  derived and/or modified sequence opt2 from anti-HIV_cap256-048-025518_VR-Chain
cagguccagcucgucgaguccggcggcggcgucguccagcccggccgcucccuccgccucuccugcgccgucuccggcuucaccuucucccagcacgccaugcacuggguccgccaggcccccggcaagggccucgagugggucacccucaucuccaacgacggcaccgagaaguucuacgccgacuccgucaagggccgcuucaccaucucccgcgacaacuccaagaacacccucuaccuccagaugaacucccucuccgucgaggacaccgccgucuacuacugcgccaaggaccucggcaagaacaaggacgacgagugggccaccgacuacuacgacaucuccaucgccuaccccguccccgacccccgcgccgucgucggcgucuucgacaucuggggccagggcaccgucgucaccgucuccucc

SEQ ID NO: 17511 - RNA, 432 nt, Artificial Sequence
  derived and/or modified sequence opt2 from anti-HIV_cap256-048-024854_VR-Chain
cagguccagcucgucgaguccggcggcggcgucguccagcccggccgcucccucacccucuccugcgccgccuccggcuucaccuucaacaacuacgacaugcacuggguccgccaggcccccggcaagggccucgagugggucgccuucacccgcuacgacggcuccaaccaguacuacgccgacuccgucaccggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17512 - RNA, 432 nt, Artificial Sequence
  derived and/or modified sequence opt2 from anti-HIV_cap256-048-024537_VR-Chain
cagguccagcucgucgaguccggcggcgccgucguccagcccggccgcucccuccgccucuccugcgucgccuccggcuucaccuucuccuccuacgccaugcacuggguccgccaggcccccggcaagggccucgacugggucgcccucaucuccuacgacggcuccaacaaguacuucgccgacuccgucaagggccgcuucgccaucucccgcgacaacuccaagaacacccucuaccuccagaugaacucccuccgccccgaggacaccgccgucuacuacugcgccaaggaccucggcggcggcgagugcgagaccugggccuccgacuacuacgacuucggcaaggacuaccccugccucgacccccgcgacgucgucggcaccuucgacaucuggguccagggcacccucgucaccgucuccucc

SEQ ID NO: 17513 - RNA, 432 nt, Artificial Sequence
  derived and/or modified sequence opt2 from anti-HIV_cap256-048-021781_VR-Chain
cagguccaccucgucgaguccggcggcggccucgucaagcccggcggcucccuccgccucuccugcgaggccuccggcuucuccuucuccaacuacgccauggacuggguccgccaggcccccggcaagggccucgagugggucgccuucgucuccuccgacggcuccaacaagaacuacgccgacuccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17514 - RNA, 432 nt, Artificial Sequence
  derived and/or modified sequence opt2 from anti-HIV_cap256-048-021758_VR-Chain
cagguccagcucgucgaguccggcggcggcgucguccagcccggccgcucccuccgccucuccugcgccgccuccggcuucaccuucucccgcuacggcaugcacuggguccgccaggcccccggcaagggccucgagugggucgccgucaucuccuacgacggcuccaaggaguacuacgccgacuccgucaagggccgcuucaccaucucccgcgacaacuccaaggacacccucuaccuccagauguccucccuccgcgucgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17515 - RNA, 432 nt, Artificial Sequence
  derived and/or modified sequence opt2 from anti-HIV_cap256-048-020988_VR-Chain
cagguccagcucgucgaguccggcggcggcgucguccagcccggccgcucccuccgccucuccugcgaggccuccgccuucaccuucuccuccuacggcaugcacuggguccgccaggcccccggcaagggccucgagugggucaccuucaucuccuacuccggcaacaacaaguacuacgccgacuccgucaagggccgcuucaccgucucccgcgacaacuccaagaacacccucuaccuccagaugaacucccucaccuccgaggacaccgccgucuacuacugcgccaaggaccucggcggcuccaagaccgacgaguggggcaccgacuacuacgaguucuggaacgccuaccccguccaggacccccgcgucgucgucggcgccuucgacaucuggggccacggcaccauggucaccgucuccucc

SEQ ID NO: 17516 - RNA, 435 nt, Artificial Sequence
  derived and/or modified sequence opt2 from anti-HIV_cap256-048-020663_VR-Chain
cagguccagcucgucgaguccggcggcggcgucguccagcccggcaugucccuccgccucuccugcgccgccuccggcuucaccuucuccaacuucggcaugcacuggguccgccaggcccccggcaagggccucgagugggucgccgucaucucccacgacggcaacaacaaguacuaccccgacuccguccagggccgcuucaccaucucccgcgagaacuccaagaacacccucuaccuccagaugaacucccucaagcccgaggacaccgccgucuacuucugcgccaaggaccucggcggcgaguccgaggucgaggagugggccuccgacuacuacgacuucggccgcgacauccccggccccgacccccgcggcgucgucggcacccucgacaucuggggccacggcaccauggucaccgucuccucc

SEQ ID NO: 17517 - RNA, 432 nt, Artificial Sequence
  derived and/or modified sequence opt2 from anti-HIV_cap256-048-020590_VR-Chain
cagguccagcucgucgaguccggcggcggcgucguccagcccggcggcgucccccgccucgccugcgccgccuccggcuucaccuucuccuccuacgccaugcacuggguccgccaggcccccggcaagggccucgagugggucaccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcggcaccaaggacgacgagugggccaccgacuacuacgacaucuccaucgccuaccccguccaggacccccgcgccgucgccggcgccuucgacaucuggggccagggcaccauggucaccgucuccucc

SEQ ID NO: 17518 - RNA, 432 nt, Artificial Sequence
  derived and/or modified sequence opt2 from anti-HIV_cap256-048-019765_VR-Chain
cagguccagcucgucgaguccggcggcggcgucguccagcccggccgcucccuccgccucuccugcgccgccuccggcuucaucuucaccaacuacgccauggacuggguccgccaggcccccggcaagggccucgagugggucgccgucaucuccuccgacggcuccaacaagaacuacgccgacuccgucaagggccgcuucaccaucucccgcgacaacuccaagaacaccgucucccuccagaugaacucccuccgcgccgaggacaccgccgucuacuacugcgccaaggaccucggcgacuccaagaaggacgagugggccaccgacuacuacgaccucuccaucgccuaccccguccccgacccccgcgccgucgucggcgccuucgacaucuggggccagggcaccauggucaccgucuccucc

SEQ ID NO: 17519 - RNA, 432 nt, Artificial Sequence
  derived and/or modified sequence opt2 from anti-HIV_cap256-048-019254_VR-Chain
cagguccagcucgucgaguccggcggcggcgucguccagcccggccgcucccuccgccucuccugcgccgccuccggcuucaccuccuccaccuacgccaugcacuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccgucuaccacugcgccaaggaccucggcggcaacaagcccgacgagugggccaccgacuacuacgaccucuccaucgccuaccccguccaggacccccgcgccgucgucggcgucuucgacaucuggggccagggcaccaucaucaccgucuccucc

SEQ ID NO: 17520 - RNA, 432 nt, Artificial Sequence
  derived and/or modified sequence opt2 from anti-HIV_cap256-048-018073_VR-Chain
cagguccagcucgucgaguccggcggcggcgucguccagcccggccgcucccuccgccucuccugcgccgccuccggcuucucccucuccuccuacgccauggacuggguccgccaggcccccggcaagggccucgagugggucgccgucaucuccuccgacggcaccaacaaguacuacgccgacuccgucaagggccgcuucaccaucacccgcgacaacuccaagaacacccucuaccuccagaugaacucccuccgcgucgaggacaccgcccucuacuacugcgccaaggacaugggcgaguccgagaaggaggagugggccuccgacuacuacgacuucggccgcgacauccccggccaggacccccgcggcgaggucggcuccuucgacaucuggggccagggcaccauggucaccgucuccucc

SEQ ID NO: 17521 - RNA, 432 nt, Artificial Sequence
  derived and/or modified sequence opt2 from anti-HIV_cap256-048-016775_VR-Chain
gagguccagcucgucgaguucggcggcggccucguccagcccggccgcucccuccgccucuccugcgccgccuccgccuucaccuucucccacuacggcauccacuggguccgccaggcccccggcaagggccucgagugggucgccgucaucucccacgacggcuccaccaaggacuacgccgacuccgucaagggccgcuucaccaucucccgcgacaacuccaagaacaccauguaccuccagaugaacucccuccgcgccgaggacaccgccgucuacuacugcgcccgcgaccucggcgaguccgagaccgaggagugggccaccgacuacuacgacuucuccaucgccuaccccguccagaacccccgcggcgucaucggcguccucgacaucuggggccucggcaccauggucaccgucuccucc

SEQ ID NO: 17522 - RNA, 432 nt, Artificial Sequence
  derived and/or modified sequence opt2 from anti-HIV_cap256-048-016069_VR-Chain
cagguccagcucgucgaguccggcggcggcgucguccagcccggccgcucccuccgccucuccugcgccgccuccggcuucaccuucuccaaguacgccaugcacuggguccgccaggcccccggcaagggccucgagugggucgccuucgucgccuucgacgaguccgccaaguucuacgccgacuccgucaagggccgcuucaccaucucccgcgacaacuccaagaacacccucucccuccagaugaacucccuccgcgccgaggacaccgccgucuacuacugcgccaaggaggucggcgagaacaaggacgacgagugggccuccgacuacuacgaccucuccaucgccuaccccguccacgacccccgcgccgucgucggcggcuucgacgucuggggccagggcaccauggucaccgucuccucc

SEQ ID NO: 17523 - RNA, 432 nt, Artificial Sequence
  derived and/or modified sequence opt2 from anti-HIV_cap256-048-015867_VR-Chain
cagguccagcucgucgaguccggcggcggcgucguccagcccggccgcucccuccgccucuccugcuccgccuccggcuucuccuucaccaacuacgccauggacuggguccgccaggcccccggcaagggccucgagugggucgccgucaucuccuccgacggcuccaacaagaacuacgccgacuccgucaagggccgcuucaccaucucccgcgacaacuccaagaacacccucuuccuccagaugaacucccuccgccccgaggacaccgccgucuacuucugcgccaaggaccucggcgccaacaaggacgacgagugggccaccgacuacuacgaccucuccaucgccuaccccguccacgacccccgcgccgucgucggcaucuucgaccucuggggccagggcaccauggucaccgucuccucc

SEQ ID NO: 17524 - RNA, 432 nt, Artificial Sequence
  derived and/or modified sequence opt2 from anti-HIV_cap256-048-015673_VR-Chain
cagguccaccucgucgaguccggcggcggcgucguccagcccggccgcucccuccgccucuccugcgccgccuccggcuucaccuucuccaacuucgccaugggcuggguccgccaggcccccggcaagggccucgagugggucgccuucaucuccuccgacggcaccaacaagaacuacggcgacuccgucaagggccgcuucaccaucucccgcgacaacuccaagaacacccucuuccuccagaugaacucccuccgcgccgaggacaccgcccucuacuacugcgccaaggaccucggcggcuacaaguccgacgagugggccaccgacuacuacgaccucuccaucgccuaccccauccaggacccccgcgccgucgucggcgccuucgacaucuggggccagggcaccauggucaccgucuccucc

SEQ ID NO: 17525 - RNA, 432 nt, Artificial Sequence
  derived and/or modified sequence opt2 from anti-HIV_cap256-048-015156_VR-Chain
cagguccagcucgucgaguccggcggcggcgucguccagcccggccgcucccuccgccucuccugcgccgccuccggcuucaccuucuccgucuacgcccuccacuggguccgccagacccccggcaagggccucgagugggucgcccucaucuccuacgacggcaccaacaaguacuacgucgacuccgucaagggccgcuucaccaucucccgcgacaacuccaagaacacccucuaccuccagaugaacucccucaccgccgaggacaccgccgucuacuacugcgccaaggaccucggcggcuccaagaacgacgagugggccaccgacuacuacgaccucuccaucgccuaccccauccaggacccccgcgccgucgccggcaucuucgacgucuggggccgcggcaccauggucaccgucuccucc

SEQ ID NO: 17526 - RNA, 432 nt, Artificial Sequence
  derived and/or modified sequence opt2 from anti-HIV_cap256-048-014521_VR-Chain
gagguccagcucgucgaguccggcggcggccucguccagcccggccgcucccuccgccucuccugcgccgccuccggcuucaucuucuccuccuacggcauccacuggguccgccagggccccggcaagggccucgagugggucgcccucaucuccggcgacggcaacaacaaguacuacgccgacuccguccagggccgcuucuccaucucccgcgacaacuccaagaacacccucuaccuccagaugaacucccuccgcgccgaggacaccgccgucuacuacugcgccaaggaccucggcgaguccgacaaggaggaguggcccuccgacuacuacgacuucggccgcgacuucaccggccaggacccccgcgccgucgucggcgucuucgacaucuggggccagggcaccaccgucaucgucuccucc

SEQ ID NO: 17527 - RNA, 432 nt, Artificial Sequence
  derived and/or modified sequence opt2 from anti-HIV_cap256-048-014475_VR-Chain
cagguccagcucgucgaguccggcggcggcgucguccagcccggccgcucccuccgccucuccugcgccgccuccggcuucaccuucaacaccuucggcaugcacuggguccgccaggcccccggcaagggccucgagugggucgccgucaucucccacgacggcaacaacaaguacuacgccgacucccucaagggccgcuucaccaucucccgcgagaacuccaagaacacccucuuccuccagaugaacucccuccgcgccgaggacaccuccgucuacuacugcgccaaggaccucggccacggcgagugcgaggagugggccuccgacuacuacgacuucggcaaggacuaccccugccucaccccccgcggcgucgccggcaccuucgacaucuggggccacggcaccaccgucaccgucuccucc

SEQ ID NO: 17528 - RNA, 432 nt, Artificial Sequence
  derived and/or modified sequence opt2 from anti-HIV_cap256-048-013798_VR-Chain
cagguccagcucgucgaguccggcggcggcgucguccagcccggccgcucccuccgccucuccugcgccgccuccggcuucaccuucaacaacuacggcacccacuggguccgccaggcccccggcaagggccucgagugggucgccgucaucuccgacuccggcuccaacaaguacuacgccgacuccgucaagggccgcuucaccaucucccgcgacaacuccaagaacacccucuaccuccagaugaacucccuccgcgccgaggacaccgccgucuacuucugcgccaaggaccucggcggccgcgagaccgaggagugggccuccgacuacuacgacuucggccgcgacuuccccggccaggaccagcgcgccgucgccggcgucuucgacauguggggccagggcaccauggucaccgucuccucc

SEQ ID NO: 17529 - RNA, 432 nt, Artificial Sequence
  derived and/or modified sequence opt2 from anti-HIV_cap256-048-013271_VR-Chain
gagguccagcucgucgaguccggcggcggcgucguccgccccggcggcucccuccgccucuccugcgccgccuccggcuucaucuucuccuccuacggcauccacuggguccgccaggcccccggcaagggccucgagugggucgccgucaucuccggcgacggcaccaacaaguacugcgccgacuccgucaagggccgcuucaccaucucccgcgacaacuccaagaacacccucuaccuccagaucaacucccuccgcgucgaggacaccgccgucuacuacugcgccaaggaccucggcaagaacaaggacgacgagugggccaccgacuacuacgaccucuccaucgccuaccccguccccgacccccgcgccgucgucggcgucuucgacaucuggggccagggcaccgucgucaccgucuccucc

SEQ ID NO: 17530 - RNA, 432 nt, Artificial Sequence
  derived and/or modified sequence opt2 from anti-HIV_cap256-048-013180_VR-Chain
cagguccagcucgucgaguccggcggcggcgucguccagcccggccgcucccuccgccucuccugcgccgccuccggcuucaccuucuccaagaacggcaugcacuggguccgccaggcccccggcaagggccucgagugggucgccuucgucgccuucgacggcuccgacaaguacuacgccgacuccgucaagggccgcuucgucaucucccgcgacaacuccaagaacacccucucccuccagaugaacucccuccgcgccgaggacaccgccgucuacuacugcgccaaggaggucggcgaggacaaggacgacgagugggccuccgacuacuacgaccucuccaucgccuaccccguccacgacccccgcgccgucgucggcggcuucgacaucuggggccagggcaccauggucaccgucuccucc

SEQ ID NO: 17531 - RNA, 432 nt, Artificial Sequence
  derived and/or modified sequence opt2 from anti-HIV_cap256-048-012148_VR-Chain
cagguccagcucgucgaguccggcggcggcgucguccagcccggccgcucccuccgccucuccugcgccgccuccggcuucaccuucacccacuacgccauggacuggguccgccaggcccccggcaagggccucgagugggucgccgucaucuccuccgacggcuccuccaagaacuacgccgacuccguccgcggccgcuucaccaucucccgcgacaacuccaagaacacccucucccuccucaugaacggccuccgccccgaggacaccgccgucuacuacugcgccaaggacgucggcgacgucaagaacgacgagugggccaccgacuacuacgaccucuccaucgccuaccccguccaggacccccgcgccgucgucggcgccuucgacuucuggggccagggcaccauggucaccgucuccgcc

SEQ ID NO: 17532 - RNA, 432 nt, Artificial Sequence
  derived and/or modified sequence opt2 from anti-HIV_cap256-048-011870_VR-Chain
cagguccagcucgucgaguccggcggcggcgucguccagcccggccgcucccuccgccucuccugcgccgucuccggcuucaccuucuccuucuacggcaugcacuggguccgccaggcccccggcaagggccucgagugggucgccgucaucuccuacgacggcaacaacaaguacuacgucgacuccgucaagggccgcuucaucaucucccgcgacaacuccaagaacacccucuaccuccagaugaacucccuccgcgucgaggacaccgccgucuacuacugcgcccgcgaccucggcgagcgcgagaacgaggagugggccaccgacuacuacgacuucuccaucgccuaccccaucgagggcccccgcggcgucgucggcgucuucgacaucuggggccgcggcaccauggucaccgucuccucc

SEQ ID NO: 17533 - RNA, 432 nt, Artificial Sequence
  derived and/or modified sequence opt2 from anti-HIV_cap256-048-011530_VR-Chain
cagguccaccucgucgaguccggcggcggcgucguccagcccggccgcucccuccgccucuccugcgccgccuccggcuucuccuuccgcaacuacgccauggacuggguccgccaggcccccggcaagggccucgagugggucgccgucaucuccuccgacggcuccgacaagcacuacgccgacuccguccgcggccgcuucaccaucucccgcgacaacuccaagaacacccucuaccuccagaugaacucccuccgcgucgaggacaccgccgucuacuacugcgccaaggaccucggcgccaacaagaacgacgagugggccaccgacuacuacgacuucuccaucgccuaccccguccccgacccccgcgccgucgucggcgccuucgacaucuggggccagggcaccauggucaccgucuccucc

SEQ ID NO: 17534 - RNA, 432 nt, Artificial Sequence
  derived and/or modified sequence opt2 from anti-HIV_cap256-048-010968_VR-Chain
cagguccagcucgucgaguccggcggcggcgucguccagcccggccgcucccuccgccucuccugcgccgccuccggcuucaucuucuccuccuacggcaugcacuggguccgccaggcccccggcaagggccucgagugggucgcccucaucuccggcgacggcuccaacaaguacuacgccgacuccgucaagggccgcuucaccaucucccgcgacaacuccaagaacacccucuaccuccagaugaacucccuccgcgccgaggacuccgcccucuacuucugcgccaaggaccucggcgaguccgacaaggaggaguggcccuccgacuacuacgacuucggccgcgacuucaccggccaggucccccgcgccgucgucggcaucuucgacauguggggccagggcaccauggucaccgucuccucc

SEQ ID NO: 17535 - RNA, 426 nt, Artificial Sequence
  derived and/or modified sequence opt2 from anti-HIV_cap256-048-010224_VR-Chain
gagguccaccucgucgaguccggcggcgaccucguccagcccggcggcucccuccgccucuccugcgucgucuccgaguucaccuucuccuccuacggcaugcacuggguccgccaggcccccggcaagggccucgagugggucgccuucauccgcuacgacggcuccaacaaguacuacgccgacuccgucaagggccgcuucaccaucucccgcgacaacuccaaggucuaccucgagaugaacucccuccgcgccgaggacaccgccgucuacuacugcgccaaggaggucggcgagaacaaggacgacgagugggccuccgacuacuacgaccucuccaucgccuaccccauccacgacccccgcgccgucgucggcggcuucgacaucuggggccagggcaccauggucaccgucuccucc

SEQ ID NO: 17536 - RNA, 432 nt, Artificial Sequence
  derived and/or modified sequence opt2 from anti-HIV_cap256-048-009749_VR-Chain
cagguccagcucgucgaguccggcggcggcgucguccagcccggccgcucccuccgccucuccugcggcgccuccggcuucaccuucuccuccuacgccaugcacuggguccgccaggcccccggccgcggccucgagugggucgccuucaccuccuccgacggcuccaacaagaacuacggcgacuccgucaagggccgcuucaccaucucccgcgacaacuccaagaacacccucuuccuccagaugaacucccuccgcgccgaggacaccgcccucuacuacugcgccaaggacgucggcgaguacaaguccgacgagugggccaccgacuacuacgaccucuccaucgccuaccccauccaggacccccgcgccauggucggcgccuucgacaucuggggccagggcaccauggucaccgucuccucc

SEQ ID NO: 17537 - RNA, 432 nt, Artificial Sequence
  derived and/or modified sequence opt2 from anti-HIV_cap256-048-009623_VR-Chain
cagguccagcucgucgaguccggcggcggcgucguccagcccggccgcucccuccgccucuccugcgccgccuccggcuucuccuucuccaaguacggcaugcacuggguccgccaggcccccggcaagggccucgagugggucgccuucgucgccuucgacgagggcgacaaguacuacgucgacuccgucaagggccgcuucaccaucucccgcgacaacuccaagaacacccucucccuccagaugaacucccuccgcgccgaggacaccgccgucuacuacugcgccaaggaggucggcgagaacaaggacgacgagugggccuccgacuacuacgaccucuccaucgccuaccccauccacgacccccgcgccgucgucggcggcuucgacaucuggggccagggcaccauggucaccgucuccucc

SEQ ID NO: 17538 - RNA, 432 nt, Artificial Sequence
  derived and/or modified sequence opt2 from anti-HIV_cap256-048-008234_VR-Chain
cagguccagcucgucgaguccggcggcggcgucguccagcccggccgcucccuccgccucuccugcgccgccuccggcuucaccuucaccaacuacgccauggacuggguccgccaggcccccggcaagggccucgagugggucgccgucaucuccuccgacggcuccaacaagaacuacgccgacuccgucaagggccgcuucaccaucucccgcgacaacuccaagaacaccgucuaccuccagauguccucccuccgccccgaggacaccgccgucuacuacugcgccaaggacgucggcgacaccaaguccgacgagugggccaccgacuacuacgaccucuccaucgccuaccccguccaggacccccgcgccgucgucggcgccuucgacaucuggggccagggcaccauggucaccgucuccucc

SEQ ID NO: 17539 - RNA, 432 nt, Artificial Sequence
  derived and/or modified sequence opt2 from anti-HIV_cap256-048-008149_VR-Chain
cagguccagcucgucgaguccggcggcggcgucguccagcccggccgcucccuccgccucuccugcgccgccuccggcuucaccuucuccgucuacaccaugcacuggguccgccaggcccccggcaagggccucgagugggucgccgucaucuccuacgacggccgcaacaaguacuacgccgacuccgucaagggccgcuucaccaucucccgcgacaacuccaagaacaccgucuaccuccagaugaacucccuccgcgucgaggacaccgccgucuacuacugcgccaaggaccucggcgccaacaaggacgacgagugggccaccgacuacuacgaccucuccgucgccuaccccguccccgacccccgcgccgucgucggcgccuucgacgucuggggccagggcaccauggucaccgucuccucc

SEQ ID NO: 17540 - RNA, 432 nt, Artificial Sequence
  derived and/or modified sequence opt2 from anti-HIV_cap256-048-007301_VR-Chain
cagguccagcucgucgaguccggcggcggcgucguccagcccggccgcucccuccgccucuccugcgccgccuccggcuucuccuucaacuacuacgccauggacuggguccgccaggcccccggcaagggccucgagugggucgccgucaucuccuccgacggccgcaacaagaacuacgccgacuccgucaagggccgcuucaccaucucccgcgacaacuccaagaacacccucuaccuccagaugaacucccucuccgucgaggacaccgccgucuacuacugcgccaaggaccucggcaagaacaaggacgacgagugggccaccgacuacuacgacaucuccaucgccuaccccguccccgacccccgcgccgucgucggcgucuucgacaucuggggccagggcaccgucgucaccgucuccucc

SEQ ID NO: 17541 - RNA, 432 nt, Artificial Sequence
  derived and/or modified sequence opt2 from anti-HIV_cap256-048-007174_VR-Chain
cagguccagcucgucgaguccggcggcggcgucguccagcccggccgcucccuccgccucuccugcgccgccuccggcuucaccuucaacuccuacggcauggccuggguccgccaggcccccggcaagggccucgagugggucgcccucaucuccuacgacggcuccaacaaguacuacgccgacuccguccgcggccgcuucaccaucucccgcgacaacuccaaggacacccucuaccuccagauggacggccuccgccccgaggacaccgcccucuacuacugcgccaaggaccucggcgaguccgagugcgaggagugggccuccgacuacuacgacuucggccgcgacuaccccugccucgccccccgcggcguccccggcaccuucgacaucuggggccagggcaccauggucaccgucuccucc

SEQ ID NO: 17542 - RNA, 432 nt, Artificial Sequence
  derived and/or modified sequence opt2 from anti-HIV_cap256-048-007079_VR-Chain
cagguccagcucgccgaguccggcggcggcgucguccagcccggccgcucccuccgccucuccugcgccgccuccggcuucaccuucuccaucuacggcaugcacuggguccgccaggcccccggcaagggccucgagugggucgccuucauccucuccgacggcaccgacaaguacuccgccgacuccgucaagggccgcuucaccaucucccgcgacaacuccaagaacacccucuaccuccagaugaacucccuccgcgccgaggacaccgccgucuacuacugcgccaaggaccucggcaaggccaaggacgacgagugggccaccgacuacuacgacuucuccaucgccuaccccguccacgacccccgcggcgucgccggcaucuucgacaucuggggccagggcaccauggucaccgucuccucc

SEQ ID NO: 17543 - RNA, 432 nt, Artificial Sequence
  derived and/or modified sequence opt2 from anti-HIV_cap256-048-007033_VR-Chain
cagguccagcucgucgaguccggcggcggcgucguccagcccggccgcucccuccgccucuccugcgccgccuccggcuucaccuucuccaacuucggcuuccacuggguccgccaggcccccggcaagggccucgagugggucgccgccaucuccuucgccggcaacaacaaguacuacgccgacuccgucaagggccgcuucaccaucucccgcgagaacuccaagaacauccucuaccuccagaugaacucccuccgcggcgaggacaccgccgucuacuacugcgccaaggaccuccgcgaguucgagugcgaggagugggccuccgacuacuacgacuucggccgcgacuaccccugccaggacccccgcggcgucgucggcaccuucgacgucuggggccacggcucccucgucaccgucuccucc

SEQ ID NO: 17544 - RNA, 432 nt, Artificial Sequence
  derived and/or modified sequence opt2 from anti-HIV_cap256-048-006128_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacggcaccgacaaguacuacgccgacuccgucaagggccgcuucaccaucucccgcgacaacuccaagaacacccucuaccuccagaugaacucccuccgcgucgaggacaccgccgucuaccacugcgccaaggaccucggcggcuccaaguccgacgagugggccaccgacuacuacgacugguccaucgccuaccccguccacgacccccgcgccgucgucggcgucuucgacaucuggggccagggcacccucgucaccgucuccucc

SEQ ID NO: 17545 - RNA, 432 nt, Artificial Sequence
  derived and/or modified sequence opt2 from anti-HIV_cap256-048-005999_VR-Chain
cagguccagcucgucgaguccggcggcggcgucguccagcccggccgcucccuccgccucuccugcgccgccuccggcuucaccuucacccacuucgccauggacuggguccgccaggcccccggcaagggccucgagugggucgccgucaucuccuccgacggcuccuccaagaacuacgccgacuccgucaagggccgcuucaccaucucccgcgacaacuccaagaacaccgucucccuccagaugaacucccuccgccccgaggacaccgccgucuacuacugcgccaaggaccucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17546 - RNA, 432 nt, Artificial Sequence
  derived and/or modified sequence opt2 from anti-HIV_cap256-048-005394_VR-Chain
cagguccagcucgucgaguccggcggcggcgucguccagcccggccgcucccuccgccucuccugcgccgccucccaguucaccuucuccuccuacggcaugcacuggguccgccaggcccccggcaagggccucgagugggucgccgccaucuccuucgccggcaccaacaaguacuacgccgacuccgucaagggccgcuucaccaucucccgcgacaacuccaagaacgcccucuaccuccagaugaacucccuccgcgccgaggacaccgcccucuacuacugcgccaaggaccuccgcgaguucgagugcgaggagugggccuccgacuacuacgacuucggccgcgacuaccccugccaggacccccgcggcgucgucggcaccuucgacaucuggggccagggcaccauggucaccgucuccucc

SEQ ID NO: 17547 - RNA, 432 nt, Artificial Sequence
  derived and/or modified sequence opt2 from anti-HIV_cap256-048-004226_VR-Chain
cagguccagcucgucgaguccggcggcggcgucguccagcccggccgcucccuccgccucuccugcgccgccuccggcuucaccuucaacaagcacggcaugcacuggguccgccaggcccccggcaagggccucgagugggucgccuucgucgccuucgacggcuccgacaaguacuacgccgacuccgucaagggccgcuucaccaucucccgcgacaacuccaagaacacccucucccuccagaugaacaaccuccgcgccgaggacaccgccgucuacuacugcgccaaggaggucggcgacaacaaggacgacgagugggccuccgacuacuacgaccucuccaucgccuaccccguccaggacccccgcgccgucgucggcggcuacgacaucuggggccagggcaccauggucaccgucuccucc

SEQ ID NO: 17548 - RNA, 432 nt, Artificial Sequence
  derived and/or modified sequence opt2 from anti-HIV_cap256-048-004097_VR-Chain
cagguccagcucgucgaguccggcggcggcgucguccagcccggccgcucccuccgccucuccugcgccgccuccggcuucaccuucuccgccuacaccguccacuggguccgccaggcccccggccgcggccucgagugggucuccgucaucuccuacgacgaccgcaacaaguacuacgcccacuccgucaagggccgcuucaccaucucccgcgacaacuccaagaacacccucuaccuccagaugaacucccuccgccgcgaggacaccgccgucuacuacugcgccaaggaccucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17549 - RNA, 432 nt, Artificial Sequence
  derived and/or modified sequence opt2 from anti-HIV_cap256-048-003289_VR-Chain
cagguccagcucgucgaguccggcggcggcgucguccagcccggccgcucccuccgccucuccugcgccgccuccggcuucaccuucuccaaguacggcaugcacuggguccgccaggcccccggcaagggccucgagugggucgccuucgucgccuucgacggcuccuccaagaacuacgccgacuccgucaagggccgcuucaccaucucccgcgacaacuccaagaacaccgucucccuccagaugaacucccuccgccccgaggacaccgccgucuacuacugcgccaaggaccucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17550 - RNA, 432 nt, Artificial Sequence
  derived and/or modified sequence opt2 from anti-HIV_cap256-048-002601_VR-Chain
cagguccagcucgucgaguccggcggcggcgucguccagcccggccgcucccuccgccucuccugcgccgccuccggcuucuccuucaacaacuacgccauggacuggguccgccaggcccccggcaagggccucgagugggucgccgucaucuccuccgacggccgcaacaagaacuacgccgaguccgucaagggccgcuucaccaucucccgcgacaacuccaagaacaccgucuaccuccagaugaacucccuccgcgccgaggacaccgccgucuacuacugcgccaaggacgucggcgacaccaagaaggacgagugggccaccgacuacuacgaccucuccaucgccuaccccguccaggacccccaggccgucgucggcgccuucgacaucuggggccagggcaccauggucaccgucuccucc

SEQ ID NO: 17551 - RNA, 432 nt, Artificial Sequence
  derived and/or modified sequence opt2 from anti-HIV_cap256-048-002129_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgcccucaucuccuacgacggcaccgacaaguacuacgccgacuccgucaagggccgcuucaucaucucccgcgacaacucccgcuccacccucuaccuccagaugaacucccuccgccucgaggacaccgccgucuaccacugcgccaaggaccucggcggcuccaaguccgacgagugggccaccgacuacuacgaccucuccgucgccuaccccguccaggacccccgcgccgucgucggcgucuucgacaucuggggccagggcaccauggucaccgucuccucc

SEQ ID NO: 17552 - RNA, 432 nt, Artificial Sequence
  derived and/or modified sequence opt2 from anti-HIV_cap256-048-001875_VR-Chain
cagguccagcucgucgaguccggcggcggcgucguccagcccggcggcucccuccgccucuccugcgccaccuccggccucaccuucuccaacuacggcaugcacuggguccgccaggcccccggccgcggccucgagugggucgccuucacccgcuacgacggcaccuacaacuacuacgccgacuccgucaagggccgcuucaccaucucccgcgacaacuccaagggcacccucuaccuccagauggacggccuccgccccgaggacaccgcccucuacuacugcgccaaggaccucggcgagcgcgagugcgaggagugggccuccgacuacuacgacuucggccgcgacuuccccugccaggacccccgcggcgucgucggcaccuucgacaucuggggccagggcaccauggucaccgucuccucc

SEQ ID NO: 17553 - RNA, 432 nt, Artificial Sequence
  derived and/or modified sequence opt2 from anti-HIV_cap256-048-001302_VR-Chain
cagguccagcucgucgaguccggcggcggcgucguccagcccggccgcucccuccgccucuccugcgccgccuccggcuucaccuucuccuacuccggcaugcacuggguccgccaggcccccggcaagggcauggagugggucgccgucaucuccuacgacggcuccaacaaguacuacgccgacuccgucaagggccgcuucaccaucucccgcgacaacuccaagaacaccgucuaccuccagaugaacucccuccgcggcgucgacaccgccgucuacuacugcgccaaggaccucggcggcggcgaggucgaggagugggccaccgacuacuacgacugguccaucgccuaccccgucgagcacccccgcgccgucgucggcgucuucgacaucuggggccagggcaccaaggucaccgucuccucc

SEQ ID NO: 17554 - RNA, 432 nt, Artificial Sequence
  derived and/or modified sequence opt2 from anti-HIV_cap256-048-001203_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccaucaucuccuacgacggcaccaucaaguacuacgccgacuccgucaagggccgcuucaccaucucccgcgacaacuccaagaacaccgucucccuccagaugaacucccuccgccccgaggacaccgccgucuacuacugcgccaaggacgucggcgccaacaaggacgacgagugggccaccgacuacuacgaccucuccaucgccuaccccguccccgacccccgcgccgucgucggcgccuucgacaucuggggccagggcaccauggucaccgucuccucc

SEQ ID NO: 17555 - RNA, 432 nt, Artificial Sequence
  derived and/or modified sequence opt2 from anti-HIV_cap256-048-000383_VR-Chain
cagguccagcucgucgaguccggcggcggcgucguccagcccggccgcucccuccgccucuccugcaccgccuccggcuucaccuucaaccacuacgccauggacuggguccgccaggcccccggcaagggccucgagugggucgccgucaucuccuccgacggcuccgacaagaccuacgccgacuccgucaagggccgcuucaccaucucccgcgacaacuccaagaacaccgucuaccuccagaugaacucccuccgcgccgaggacaccgccgucuacuacugcgccaaggacgucggcggcuccaaggacgacgagugggccaccgacuacuacgaccucuccaucgccuaccccguccccgacccccgcgccgucgucggcgccuucgacuucuggggccccggcaccauggucaccgucuccucc

SEQ ID NO: 17556 - RNA, 432 nt, Artificial Sequence
  derived and/or modified sequence opt2 from anti-HIV_cap256-038-261791_VR-Chain
cagguccagcucgucgaguucggcggcggcgucguccagcccggcggcucccuccgccucuccugcgccgccuucggcuucaccaucuccuccuacggcaugcacuggguccgccaggcccccggcaagggccuccagugggucgccuucauccgcuacgacgaguccuccaaguucuacgccgacuccgucaagggccgcuucaccaucucccgcgacaacuccgagaacacccucuaccuccagaugaacucccuccgcgccgaggacaccgccgucuacuacugcgccaaggaccucggcgaguccgagaacgaggagugggccaccgacuacuacgacuucuccaucgccuaccccggccaggacccccgcggcgucgucggcaucuucgacaucuggggccagggcaccauggucaccgucuccucc

SEQ ID NO: 17557 - RNA, 432 nt, Artificial Sequence
  derived and/or modified sequence opt2 from anti-HIV_cap256-038-241540_VR-Chain
cagguccagcucgucgaguccggcggcggcgucguccagcccggccgcucccuccgccucuccugcgccgccuccggcuucaccuucuccaacuccgccaugcacuggguccgccaggcccccggcaagggccucgagugggucgcccucaucuccuacgucggcggcaacaucuacuacgccgacuccgucaagggccgcuucaccgucucccgcgacaacuccaagaagacccucuaccuccagaugaacucccuccgcgucgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17558 - RNA, 432 nt, Artificial Sequence
  derived and/or modified sequence opt2 from anti-HIV_cap256-038-235677_VR-Chain
cucguccagcucgucgaguccggcggcggcgucguccagcccggcggcucccuccgccucuccugcgccgccuccggcuuccgcuucuccuccuacggcaugcacuggguccgccaggcccccggcaagggccucgagugggucgccuucauccgcuacgacggcuccuucaaggacuacgccgacuccguccgcggccgcuucaccaucucccgcgagaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17559 - RNA, 435 nt, Artificial Sequence
  derived and/or modified sequence opt2 from anti-HIV_cap256-038-234314_VR-Chain
gagguccagcuccucgaguccggcggcggccucguccagcccggcggcucccuccgccucuccugcgccgccuccggcuucaccuucucccgcuacgccauguccuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccuacuggcuccccugccccaaguaccacggcgccuggcucgagcuccucuacaucuggggccagggcaccauggucaccgucuccucc

SEQ ID NO: 17560 - RNA, 432 nt, Artificial Sequence
  derived and/or modified sequence opt2 from anti-HIV_cap256-038-234273_VR-Chain
gagguccagcucgucgaguccggcggcggccucauccagcccggcggcucccuccgccucuccugcgccgccuccggcuucaccgucuccaccaacuucauguccuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17561 - RNA, 432 nt, Artificial Sequence
  derived and/or modified sequence opt2 from anti-HIV_cap256-038-223164_VR-Chain
gagguccagcucgucgaguccggcggcggccucguccgccccggcggcucccuccgccucuccugcgccgccuccggcuucucccucggcuccuacuggaugaccuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacccccgcggcgucgucggcaccuucgacaucuggggccagggcaccauggucaccgucuccucc

SEQ ID NO: 17562 - RNA, 432 nt, Artificial Sequence
  derived and/or modified sequence opt2 from anti-HIV_cap256-038-220289_VR-Chain
gagguccagcucgucgaguccggcggcggccucguccagcccggcggcucccuccgccucuccugcaccgccuccggcuucaccuucuccuccuacgagaugaacuggguccgccaggcccccggcaagggccccgagugggucgccgucaucuccuacgacggcaacaacaaguacuacgccgacuccgucaagggccgcuucaccaucucccgcgagaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17563 - RNA, 432 nt, Artificial Sequence
  derived and/or modified sequence opt2 from anti-HIV_cap256-038-220020_VR-Chain
cagguccagcucgucgaguccggcggcggcgucguccagcccggccgcucccuccgccucuccugcgccgccuccggcuucaccuucucccgcaacgccaugcacuggguccgccaggcccccggcaagggccucgagugggucgcccucaucuccuacgacggcuccaacaaguacuacgucgacuccgucaagggccgcuucaccaucucccgcgacaacuccaagaacacccucuaccuccagaugaacucccuccgcgccgacgacaccgccgucuacuacugcgccaaggaccucggcgaguccgagaccgaggaguggggcaccgacuacuacgacuucuccaccggcuaccccguccaggacccccgcggcgucgucggcgccuucgacaucuggggccagggcaccauggucuccgucuccucc

SEQ ID NO: 17564 - RNA, 432 nt, Artificial Sequence
  derived and/or modified sequence opt2 from anti-HIV_cap256-038-216853_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguacuacgccgacuccgucaagggccgcuucaccaucucccgcgacaacuccaagaacacccucuacguccagaugaacucccuccgcgccgaggacaccgccgucuacuacugcgcccgcgaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17565 - RNA, 432 nt, Artificial Sequence
  derived and/or modified sequence opt2 from anti-HIV_cap256-038-213466_VR-Chain
gagguccagcucgucgaguccggcggcggccucguccagcccggccgcucccuccgcgucuccugcgccgccuccggcuucaccuucgaggacuacgccaugcacuggguccgccaggcccccggcaagggccucgagugggucgccgucaucuccgacgacggcaacaacaaguacuacgccgacuccgucaagggccgcuucaccaucucccgcgacaacuccaagaacacccucuaccuccagaugaacucccuccgcgucgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17566 - RNA, 432 nt, Artificial Sequence
  derived and/or modified sequence opt2 from anti-HIV_cap256-038-213212_VR-Chain
cagguccagcucgucgaguccggcggcggcgucguccagcccggcggcucccuccgccucuccugcgccgccuccggcuucaucuucuccgacuacggcaugcacuggguccgccaggcccccggcaagggccucgagugggucgccuccaucuggcacgacggcuccaagaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaucgaggaguggaccuccgacuacuacgacuucggccgcgacuaccccggccaggacccccgcggcgucuucggcaccuucgacaucuggggccacggcaccauggucaccgucuccucc

SEQ ID NO: 17567 - RNA, 432 nt, Artificial Sequence
  derived and/or modified sequence opt2 from anti-HIV_cap256-038-213120_VR-Chain
cagguccaccucgucgaguccggcggcggccucgucaagcccggcggcucccuccgccucuccugcgccgccuccggcuucaccuucuccgacuacuacaugaucuggauccgccaggcccccggcaagggccucgagugggucgccgucaucuccuccgacggcuccaacaagaacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucgccaccggcuaccccguccaggacccccgcgccgucgucggcgccuucgacaucuggggccagggcaccauggucaccgucuccccc

SEQ ID NO: 17568 - RNA, 432 nt, Artificial Sequence
  derived and/or modified sequence opt2 from anti-HIV_cap256-038-212592_VR-Chain
cucguccagcucgucgaguccggcggcggcgucguccagcccggcaagucccuccgccucuccugcgccgccuccggcuucaccuucuccuccuacgccaugcacuggauccgccaggcccccggcaagggccucgagugggucgccgucaucuccgacgacggcuccaucaagaacuacgccgacuccgucaagggccgcuucaccaucucccgcgacaccuccaagaagcucauguaccuccagaugaacucccucuccgccaacgacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17569 - RNA, 432 nt, Artificial Sequence
  derived and/or modified sequence opt2 from anti-HIV_cap256-038-211790_VR-Chain
gagcuccagcucgucgaguccggcggcggccucguccagcccggcggcucccuccgccucuccugcgucgucuccggcuucaccgucuccaccaacuacaucuccuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacccccgcggcgucgucggcaccuucgacaucuggggccagggcaccauggucaccgucuccucc

SEQ ID NO: 17570 - RNA, 432 nt, Artificial Sequence
  derived and/or modified sequence opt2 from anti-HIV_cap256-038-209916_VR-Chain
cagguccagcucgucgaguccggcggcggcgucguccagcccggcggcucccuccgccucuccugcgccgccuccggcuucaccuucuccuccuucggcaugcacuggguccgccaggcccccggcaagggccucgagugggucuccuucauccgcaacgacggcggcauccgcuacuccgccgacuccguccgcggccgcuucaccaucucccgcgacaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17571 - RNA, 432 nt, Artificial Sequence
  derived and/or modified sequence opt2 from anti-HIV_cap256-038-207938_VR-Chain
cagguccagcucgucgaguccggcggcggcgucguccaccccggccgcucccuccgccucuccugcgccgccuccggcuucaccuucuccuccuacggcaugcacuggguccgccaggcccccggcaagggccucgagugggucgccgucaucucccacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgucuucgacaucuggggccagggcaccauggucaccgucuccucc

SEQ ID NO: 17572 - RNA, 432 nt, Artificial Sequence
  derived and/or modified sequence opt2 from anti-HIV_cap256-038-202245_VR-Chain
cagguccaccucgucgaguccggcggcggcgucguccagcccggccgcucccuccgccucuccugcaccgucuccggcuucaccuucggcuccuacgcccuccacuggguccgccaggcccccggcaagggccucgaguggcucuccgucaucuccuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaaggaggagugggccuccgacuacuacgacuucggccgcgacuaccccggccaggacccccgcggcgucgucggcaccuucgacaucuggggccacggcaccauggucaccgucuccucc

SEQ ID NO: 17573 - RNA, 432 nt, Artificial Sequence
  derived and/or modified sequence opt2 from anti-HIV_cap256-038-197721_VR-Chain
cagguccagcucgucgaguccggcggcggcgucguccagcccggcaagucccuccgccucuccugcgccggcuccggcuucaucuucuccaacuaccccaugcacuggguccgccaggcccccggcaagggccucgaguggauggccgacgucuccuacgacggcuccaacaaggacuacgccgacuccgucaagggccgcuucaccaucucccgcgacaacuccaagaacacccucuaccuccagaugaacucccuccgcgccgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17574 - RNA, 432 nt, Artificial Sequence
  derived and/or modified sequence opt2 from anti-HIV_cap256-038-196679_VR-Chain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucgccgucaucuccuacgacggcggcaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacucccgcggcgucgucggcaccuucgacgucuggggccagggcaccauggucaccgucuccucc

SEQ ID NO: 17575 - RNA, 438 nt, Artificial Sequence
  derived and/or modified sequence opt2 from anti-HIV_cap256-038-196118_VR-Chain
cagguccagcucgucgaguccggcggcggcgucguccagcccggcggcucccuccgccucuccugcgccgccuccggcuucaccuucuccaccuacggcaugcacuggguccgccaggcccccggcaagggccucgagugggucaccuucauccgcaacgacggcaccaacaaguacuacgccgacuccgucaagggccgcuucaccaucucccgcgacaacaccaagaacacccucuaccuccagauguacucccuccgcgccgaggacaccgccgucuacuacugcgccaaggaccucggcgaguccgagaacgaggacgaggagugggccuccgacuacuacgacuucggccgcgacuaccccggccaggacucccgcggcgucgucggcaccuucgacauguggggccagggcaccauggucaccgucuccucc

SEQ ID NO: 17576 - RNA, 429 nt, Artificial Sequence
  derived and/or modified sequence opt2 from anti-HIV_cap256-038-195382_VR-Chain
cagguccaccucgucgaguccggcggcggcgucguccagcccggccgcucccuccgccucuccugcgccgccuccggcuucaccuucuccaacuaccccguccacuggguccgccaggcccccggcaagggccucgagugggucgccgucaucuccuucgacggcaucaacaacuacgccggcuccgucaagggccgcuucaucaucucccgcgacaacuccaagaacacccucuaccuccagaugaacucccuccgcgccgaggacaccgccgucuacuacugcgucaaggaccucggcgaguccgagaaggaggaguggcccuccgacuacuacgacuucggccgcgacuaccccggccaggacucccgcggcgucgucggcgucuucgacaucuggggccagggcaccauggucaccgucuccucc

SEQ ID NO: 17577 - RNA, 432 nt, Artificial Sequence
  derived and/or modified sequence opt2 from anti-HIV_cap256-038-180001_VR-Chain
gagguccagcucgucgaguccggcggcggccucguccagcccggccgcucccuccgccucuccugcaccgccuccggcuucaccuucggcgacuacgccauguccugguuccgccaggcccccggcaagggccucgagugggucgccgacaucuccuacgacggcuccaacaaguacuacgccgacuccgucaagggccgccucaccaucucccgcgacaacuccaagaacacccucuaccuccagaugaacucccuccgcgccgaggacaccgccgucuacuacugcgucaaggaccucggcgaguccgagaaggaggaguggcccuccgacuacuacgacuucggccgcgacuaccccggccaggacucccgcggcgucgucggcgucuucgacaucuggggccagggcaccauggucaccgucuccucc

SEQ ID NO: 17578 - RNA, 432 nt, Artificial Sequence
  derived and/or modified sequence opt2 from anti-HIV_cap256-038-178021_VR-Chain
caggucaagcucgucgaguccggcggcggcgucguccagcccggcggcucccuccgccucuccugcgccgccgccggcuucaucuucuccaacuccggcaugcacuggguccgccaggcccccgacaagggccucgagugggucgccuucguccccuacgacggcuccaacaaguacuacgccgacuccgucaagggccgcuucaccaucucccgcgacaacuccaagaacacccucucccuccagaugaacucccuccgcaccgaggacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17579 - RNA, 432 nt, Artificial Sequence
  derived and/or modified sequence opt2 from anti-HIV_cap256-038-177104_VR-Chain
gagguccagcuccucgaguccggcggcggccucguccagcccggcggcucccuccgccucuccugcgccgccuccggcuucaccuucuccuccuacgccaugaacuggguccgccaggcccccggcaagggccucgagugggucgccgucaucuccuacgacggcggcgacaaguacuacgccgacuccgucaagggccgcuucaccaucucccgcgacaacuccaagaacacccucuaccuccagaugaacucccuccgcgucgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17580 - RNA, 432 nt, Artificial Sequence
  derived and/or modified sequence opt2 from anti-HIV_cap256-038-171261_VR-Chain
cagguccagcucgucgaguccggcggcggcgucguccagcccggccgcucccuccgccucuccugcgccgccuccggcuucaccuucuccuccuacgccauguacuggguccgccaggcccccggcaagggccucgagugggucgccgucaucuccuccgacggcuccgacaagaacuacgccgacuccgucaagggccgcuucaccaucucccgcgacaacuccaacaacacccucuaccuccagaugaacucccuccgcgccgaggacaccgccgucuacuacugcgcccgcgaccucggcgaguccgagaacgaggaguggcccuccgacuacuacgacuucggccgcgacuaccccggccaggacccccgcggcgucaucggcaccuucgacgucuggggccagggcaccauggucaccgucuccucc

SEQ ID NO: 17581 - RNA, 432 nt, Artificial Sequence
  derived and/or modified sequence opt2 from anti-HIV_cap256-038-169090_VR-Chain
cagguccagcucgucgaguccggcggcggcgucguccagcccggccgcucccuccgccucuccugcgccgccucccgcuucaccuucaagaccuacaccaugcacuggguccgccaggcccccggcaagggccucgagugggucgcccucaucuccuacgacggcuccaacaaguacuacgccgacuccgucaagggccgccucaccaucucccgcgacaacuccaagaacacccucuaccuccagaugaacucccuccgcgccgaggacaccgccgucuacuacugcgucaaggaccucggcgaguccgagaaggaggaguggcccuccgacuacuacgacuucggccgcgacuaccccggccaggacucccgcggcgucgucggcgucuucgacaucuggggccagggcaccauggucaccgucuccucc

SEQ ID NO: 17582 - RNA, 432 nt, Artificial Sequence
  derived and/or modified sequence opt2 from anti-HIV_cap256-038-168705_VR-Chain
gagguccagcucgucgaguccggcggcggccucgucaagcccggcggcucccuccgccucuccugcgccgccuccggcuucaccuucuccuccuacuccaugaacuggguccgccgcgcccccggcaagggccucgagugggucgcccucaucuccuacgacgagaacaagaaguacuacgccgacuccgucaagggccgcuucaccaucucccgcgagaacuccaagaacacccucuaccuccagaugaacucccuccgcgccgaggacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17583 - RNA, 432 nt, Artificial Sequence
  derived and/or modified sequence opt2 from anti-HIV_cap256-038-167685_VR-Chain
cagguccagcucgucgaguccggcggcggcgucguccagcccggccgcucccuccgccucuccugcgccgccuccggcaucaccuucuccuccuacgccauccacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucggcuaccccggccaggacccccgcggcgucgucggcgccuucgacaucuggggccagggcaccauggucaccgucucccuc

SEQ ID NO: 17584 - RNA, 432 nt, Artificial Sequence
  derived and/or modified sequence opt2 from anti-HIV_cap256-038-158775_VR-Chain
cagguccagcucgucgaguccggcggcggcgucguccagcccggcggcucccuccgccucuccugcgccgccuccggcuucaccuucuccaccuacggcaugcacuggguccgccaggcccccggcaagggccucgagugggucgccuucauccgcgacaacggcuccaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacucccgcggcgucgucggcaccuucgacgucuggggccagggcaccauggucaccgucuccucc

SEQ ID NO: 17585 - RNA, 432 nt, Artificial Sequence
  derived and/or modified sequence opt2 from anti-HIV_cap256-038-157318_VR-Chain
cacguccagcucgucgaguccggcggcggcgucguccagcccggccgcucccuccgccucuccugcgccgccuccggcaucaccuucuccaccuacgacaugcacuggguccgccaggcccccggcaagggccucgagugggucgccgucaucuccaacgacggcuccaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaaggaggagugggccuccgacuacuacgacuucggccgcgacuaccccggccaggacccccgcggcgucgucgccaccuucgacaucuggggccagggcaccauggucaccgucuccucc

SEQ ID NO: 17586 - RNA, 432 nt, Artificial Sequence
  derived and/or modified sequence opt2 from anti-HIV_cap256-038-153058_VR-Chain
cagguccagcucgucgaguccggcggcggcgucguccagcccggccgcucccuccgccucuccugcgccgccuccggcuucaccuucuccaccuacgccaugcacuggguccgccaggcccccggcaagggccucgagugggucgccgucaucuccuacgacggcucccacuccuacuacgccggcuccgucaagggccgcuucaccaccucccgcgacaacuccaagaacacccucaaccuccagaugaacucccuccgccccgaggacaccgcccucuacuacugcgccaaggaccucggcgaguccgagaacgaggagugggccuccgacuacuacgacuucggccgcgacuaccccggccaggacucccgcggcgucgucggcaccuucgacgucuggggccagggcaccauggucaccgucuccucc

SEQ ID NO: 17587 - RNA, 432 nt, Artificial Sequence
  derived and/or modified sequence opt2 from anti-HIV_cap256-038-150027_VR-Chain
cucguccagcucgucgaguccggcggcggcgucguccagcccggcggcucccuccgccucuccugcgccgccuccggcuuccgcuucuccuccuacggcaugcacuggguccgccaggcccccggcaagggccucgagugggucgccuucauccgcuacgacggcuccuucaaggacuacgccgacuccguccgcggccgcuucaccaucucccgcgacaacuccaagaacaccgucuacguccagaugaacucccuccgcgccgaggacaccgccgucuacuacugcgccaaggaccucggcgaguccgagaacgaggagugggccaccgacuacuacgacuucgccaccggcuaccccguccaggacccccgcgccgucgucggcgccuucgacaucuggggccagggcaccauggucaccgucuccccc

SEQ ID NO: 17588 - RNA, 432 nt, Artificial Sequence
  derived and/or modified sequence opt2 from anti-HIV_cap256-038-146372_VR-Chain
cagguccagcucgucgaguccggcggcggcgucguccagcccggccgcucccuccgccucuccugcgccgccuccggcuucaccuucuccuccuucggcaugcacuggguccgccagucccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcaccgacgacaccgccgucuacuacugcgccaaggaccucggcgaguccgagaccgaggagugggccaccgacuacuacgacuucgccaccggcuaccccguccaggacccccgcgccgucgucggcgccuucgacaucuggggccagggcaccauggucaccgucuccccc

SEQ ID NO: 17589 - RNA, 432 nt, Artificial Sequence
  derived and/or modified sequence opt2 from anti-HIV_cap256-038-141868_VR-Chain
gagcuccgccucgucgaguccggcggcaaccucguccagcccggcggcucccucacccucuccugcgucgccuccggcuucaccuucgacuccuacggcauguccuggguccgccaggcccccggcaagggccucgagugggucgcccucaucuccuacgacgagaacaagaaguacuacgccgacuccgucaagggccgcuucaccaucucccgcgagaacuccaagaacacccucuaccuccagaugaacucccuccgcgccgaggacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17590 - RNA, 432 nt, Artificial Sequence
  derived and/or modified sequence opt2 from anti-HIV_cap256-038-141616_VR-Chain
gagguccagcuccucgaguccggcggcggccucguccagcccggcggcucccuccgccucuccugcgccgccuccggcuucaccuucuccuccuacgccauguccuggguccgccaggcccccggcaagggccucgagugggucgccgucaucuccaaggacggcuccgacaacuccuacgucgacuccgucaagggccgcuucaccaucucccgcgacaacuccaagaacacccucuaccuccagaugaacucccuccgcgccgaggacaccgccgucuacuacugcgcccgcgaccucggcgaguccgagaacgaggaguggcccuccgacuacuacgacuucggccgcgacuaccccggccaggacccccgcggcgucaucggcaccuucgacgucuggggccagggcaccauggucaccgucuccucc

SEQ ID NO: 17591 - RNA, 432 nt, Artificial Sequence
  derived and/or modified sequence opt2 from anti-HIV_cap256-038-127989_VR-Chain
caggcccagcucgucgaguccggcggcggcgucguccagcccggccgcucccuccgccucuccugcgccgccuccggcuucaccuucuccaacuucgccaugcacuggguccgccaggcccccggcaagggccucgagugggucgccgucauguccgacgacggcuccaacaaguacuacgccgacuccgucaagggccgcuucaccaucucccgcgacaacuccgagaacacccucuaccuccagaugaacucccuccgcgccgaggacaccgccgucuacuacugcgccaaggaccucggcgaguccgagaccgaggagugggccaccgacuacuacgacuucggcaccggcuaccccggccaggacccccgcgccaugaucggcaccuucgacaucuggggccgcggcaccauggucaccgucuccucc

SEQ ID NO: 17592 - RNA, 432 nt, Artificial Sequence
  derived and/or modified sequence opt2 from anti-HIV_cap256-038-118109_VR-Chain
cagguccagcucgucgaguccggcggcggcgucguccagcccggcggcucccuccgccucuccugcaccgccuccggcuucaccuucuccgccuacgacaugcacuggauccgccaggcccccggcaagggccucggcugggucgccuucaucaccaacgagggcuccuccaagaacuacgucgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucgccuaccccggccaggacccccgcggcgucgucggcaucuucgacaucuggggccagggcaccauggucaccgucuccucc

SEQ ID NO: 17593 - RNA, 432 nt, Artificial Sequence
  derived and/or modified sequence opt2 from anti-HIV_cap256-038-112226_VR-Chain
gagguccagcucgucgaguccggcggcggccucguccagcccggcggcucccuccgccucuccugcgccgccuccggcuucaccuucuccuccuacuggaugaccuggguccgccaggcccccggcaagggccucgagugggucgccgucaucuccgacgacggcaacaacaaguacuacgccgacuccgucaagggccgcuucaccaucucccgcgacaacuccaagaacacccucuaccuccagaugaacucccuccgcgucgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17594 - RNA, 432 nt, Artificial Sequence
  derived and/or modified sequence opt2 from anti-HIV_cap256-038-105918_VR-Chain
gagguccagcuccucgaguccggcggcggccucguccagcccggcggcucccuccgccucuccugcgccgccuccggcuucaccuucaacauccaccccaugcacuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17595 - RNA, 432 nt, Artificial Sequence
  derived and/or modified sequence opt2 from anti-HIV_cap256-038-104487_VR-Chain
cucguccagcucgucgaguccggcggcggcgucguccagcccggcaagucccuccgccucuccugcgccgccuccggcuucaccuucuccuccuacgccaugcacuggauccgccaggcccccggcaagggccucgagugggucgccgucaucuccgacgacggcuccaucaagaacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacggcuucuccaucggcuaccccggccaggacccccgcggcgucgucggcaucuucgacaucugggcccagggcaccauggucaccgucuccucc

SEQ ID NO: 17596 - RNA, 432 nt, Artificial Sequence
  derived and/or modified sequence opt2 from anti-HIV_cap256-038-102308_VR-Chain
cagguccagcucgucgaguccggcggcggcgucguccagcccggcggcucccuccgccucuccugcgccgcccucgacuuccccuucuccuccuucggcaugcacuggguccgccagacccccggccgcggccucgagugggucgccaucaucugguccgacggcuccaaccgcuacuacgucgacuccgucaagggccgcuucaccaucucccgcgacaacuccaagaacacccucuaccuccagaugaacucccuccgccccgacgacaccgccgucuacuacugcgucaaggaccucggcgaguccgagaacgaggagugggccaccgacuacuacgacuucuccgucggcuaccccggccagggcccccgcggcgucgucggcaucuucgacaucuggggccagggcaccauggucaccgucuccucc

SEQ ID NO: 17597 - RNA, 432 nt, Artificial Sequence
  derived and/or modified sequence opt2 from anti-HIV_cap256-038-091115_VR-Chain
cagguccagcucgucgaguccggcggcggcgucguccagcccggccgcucccuccgccucuccugcgccgucuccggcuucaccuucuccuccuacggccuccacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaucaacucccuccgcgccgaggacaccgccgucuacuacugcgccaaggaccucggcgaguccgagaacgaggagugggccaccgacuacuacgacuucuccaucggcuaccccggccaggacccccgcgccgucgucggcgccuucgacaucuggggccagggcaccauggucaccgucuccucc

SEQ ID NO: 17598 - RNA, 432 nt, Artificial Sequence
  derived and/or modified sequence opt2 from anti-HIV_cap256-038-090262_VR-Chain
cagguccagcucgucgaguccggcggcggcgucguccaggccggcggcucccuccgccucuccugcgccgccuccggcuucaccuucaacaacuacggcaugcacuggguccgccaggcccccggcaagggccucgagugggccgccuucauccgcuacgacggcuccaacaaguacuacgccgacuccguccgcggccgcuucaccaucucccgcgacaacuccaagaacacccucuaccuccagaugaacucccuccgcgccgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17599 - RNA, 432 nt, Artificial Sequence
  derived and/or modified sequence opt2 from anti-HIV_cap256-038-083260_VR-Chain
cagguccagcucgucgaguccggcggcggccucgucaagcccggcggcucccuccgccucuccugcgccgccuccggcuucaccuucuccgacuacuacaugaccuggauccgccaggcccccggcaagggccucgagugggucgccgucaucuccuacgacggcggcaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacucccgcggcgucgucggcaccuucgacgucuggggccagggcaccauggucaccgucuccucc

SEQ ID NO: 17600 - RNA, 432 nt, Artificial Sequence
  derived and/or modified sequence opt2 from anti-HIV_cap256-038-080981_VR-Chain
cagguccagcucgucgaguccggcggcggcgucguccagcccggccgcucccuccgccucuccugcgccgccuccggcuucaccuucuccuccuacggcaugcacuggguccgccaggcccccggcaagggcauggagugggucgccgucaucuccuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccaucggcuaccccggccaggacccccgcggcgucgucggcgccuucgacaucuggggccagggcaccauggucaccgucuccucc

SEQ ID NO: 17601 - RNA, 432 nt, Artificial Sequence
  derived and/or modified sequence opt2 from anti-HIV_cap256-038-080873_VR-Chain
cucguccagcucgucgaguccggcggcggcgucguccagcccggcggcucccuccgccucuccugcgccgccuccggcuuccgcuucuccuccuacggcaugcacuggguccgccaggcccccggcaagggccucgagugggucgccuucauccgcuacgacggcuccuucaaggacuacgccgacuccguccgcggccgcuucaccaucucccgcgacaacuccaagaacaccgucuaccuccagaugaacucccuccgcgccgaggacaccgccgucuacuacugcgucaaggaccucggcgaguccgagaaggaggaguggcccuccgacuacuacgacuucggccgcgacuaccccggccaggacucccgcggcgucgucggcgucuucgacaucuggggccagggcaccauggucaccgucuccucc

SEQ ID NO: 17602 - RNA, 432 nt, Artificial Sequence
  derived and/or modified sequence opt2 from anti-HIV_cap256-038-074413_VR-Chain
cagguccagcucgucgaguccggcggcggcgucguccagcccggcggcucccuccgccucuccugcgccgccuccggcuucaccuucuccaccuacggcaugcacuggguccgccagccccccggcaagggccucgagugggucgccuucauccgcuacgacggcuccaacaccuacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccuccgacuacuacgacuucggccgcgacuaccccggccaggacccccgcggcgucgucggcgucuucgacaucuggggccagggcaccauggucaccgucuccucc

SEQ ID NO: 17603 - RNA, 432 nt, Artificial Sequence
  derived and/or modified sequence opt2 from anti-HIV_cap256-038-073153_VR-Chain
cagguccagcucgucgaguccggcggcggcgucguccagcccggccgcucccuccgccucuccugcgccgccuccggcuucaccuucuccuccuacggcaugcacuggguccgccaggcccccggcaagggccucgagugggucgcccucaucuccuacgacggcaccaacaaguacuacgccgacuccgucaagggccgcuucaccaucucccgcgacaacuccaagaacacccucuuccuccagaugaacucccuccgcgccgaggacaccgcccucuacuacugcgccaaggaccucggcgaguccgagaacgaggagugggccuccgacuacuacgacuucggccgcgacuaccccggccaggacccccgcggcgucgucggcaccuucgacaucuggggccagggcaccauggucaccgucuccucc

SEQ ID NO: 17604 - RNA, 432 nt, Artificial Sequence
  derived and/or modified sequence opt2 from anti-HIV_cap256-038-064227_VR-Chain
gagguccaggucgucgaguccggcggcggccucguccagcccggcggcucccuccgccucuccugcgccgccuccggcuucaccuucuccaacuacuggauguccuggguccgccaggcccccggcaagggccucgagugggucgccgucauguccuucuccggcuccggcuccuacuacgccgacuccgucaagggccgcuucaccaucuccuccgacgacuccaugaacaccgucuaccuccagaugaacucccuccgcgccgaggacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17605 - RNA, 432 nt, Artificial Sequence
  derived and/or modified sequence opt2 from anti-HIV_cap256-038-061640_VR-Chain
cagguccagcucgucgaguccggcggcggcgucguccagcccggccgcucccuccgccucuccugcaccgccucccgcuucuccuucaacaacuacgccaugcacuggguccgccaggcccccggcaagggccucgagugggucgccaucaucuccaaggacggcuccgacaacuccuacgucgacuccgucaagggccgcuucaccaucucccgcgacaacuccaagaacacccucuaccuccagaugaacucccuccgcgccgaggacaccgccgucuacuacugcgcccgcgaccucggcgaguccgagaacgaggaguggcccuccgacuacuacgacuucggccgcgacuaccccggccaggacccccgcggcgucaucggcaccuucgacgucuggggccagggcaccauggucaccgucuccucc

SEQ ID NO: 17606 - RNA, 414 nt, Artificial Sequence
  derived and/or modified sequence opt2 from anti-HIV_cap256-038-059482_VR-Chain
cgcggcguccagugccagguccagcucgucgaguccggcggcggcgucguccagcccggcuucaccuucuccuccuacgucaugcacuggguccgccaggcccccggcaagggccucgagugggucgccgacaucuccuacgacggcuccaacaaguacuacgccgacuccgucaagggccgccucaccaucucccgcgacaacuccaagaacacccucuaccuccagaugaacucccuccgcgccgaggacaccgccgucuacuacugcgucaaggaccucggcgaguccgagaaggaggaguggcccuccgacuacuacgacuucgccaccggcuaccccguccaggacccccgcgccgucgucggcgccuucgacaucuggggccagggcaccauggucaccgucuccccc

SEQ ID NO: 17607 - RNA, 432 nt, Artificial Sequence
  derived and/or modified sequence opt2 from anti-HIV_cap256-038-054000_VR-Chain
gagguccagcucgucgaguccggcggcuccgucguccgccccggcggcucccuccgccucuccugcgccgccuccggcuucaccuucgacgacuccggcauguccuggguccgccagggccccggcaagggccucgagugggucgccgucaucuccuacgacggcggcaacaaguacuacgccgacuccgucaagggccgcuucaccaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacucccgcggcgucgucggcaccuucgacgucuggggccagggcaccauggucaccgucuccucc

SEQ ID NO: 17608 - RNA, 432 nt, Artificial Sequence
  derived and/or modified sequence opt2 from anti-HIV_cap256-038-050554_VR-Chain
gagguccagcuccucgaguccggcggcgaccucguccaguccggcggcucccuccgccucuccugcgucgccuccggcuucaccuucuccacccacgccaugaccuggguccgccaggcccccggcaagggccucgagugggucgccgucaucuccuccgacggcuccaacaagaacuucgccgacuccgucaagggccgcuucaccaucucccgcgacaacuccaagaacacccucuaccuccagaugaacucccuccgccccgaggacaccgccgucuacuacugcgccaaggaccucggcgaguccgagaacgaggagugggccaccgacuacuacgacuucuccaccggcuaccccguccaggacccccgcgccgucgucggcgccuucgacaucuggggccagggcaccauggucaccgucuccucc

SEQ ID NO: 17609 - RNA, 432 nt, Artificial Sequence
  derived and/or modified sequence opt2 from anti-HIV_cap256-038-044256_VR-Chain
cagguccagcucgucgaguccggcggcggcgucguccagcccggccgcucccuccgccucuccugcgccgccuccggcuucaccuucuccuccuacgccaugcacuggguccgccaggcccccggcaagggccucgagugggucgccgucaucuccuacgacggcuccaacaaguaccacgccggcuccgucaagggccgcuucaucaucucccgcgacaacuccaagaacacccucuaccuccagaugaacucccuccgcgccgaggacaccgcccucuacuacugcgccaaggaccucggcgaguccgagaacgaggagugggccuccgacuacuacgacuucggccgcgacuaccccggccaggacccccgcggcgucgucggcaccuucgacaucuggggccagggcaccauggucaccgucuccucc

SEQ ID NO: 17610 - RNA, 432 nt, Artificial Sequence
  derived and/or modified sequence opt2 from anti-HIV_cap256-038-040944_VR-Chain
cagguccagcucgucgaguccggcggcggcgucguccagcccggccgcucccuccgccucuccugcgccgccuccggcuucaccuucuccaacuacgccauggacuggguccgccaggcccccggcaagggccucgagugggucgccgucaucuccuacgacggcuccaacaaguacuacgccgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaccggcuaccccggccaggacccccgcgccgucgucggcgccuucgacaucuggggccagggcaccauggucaccgucuccucc

SEQ ID NO: 17611 - RNA, 432 nt, Artificial Sequence
  derived and/or modified sequence opt2 from anti-HIV_cap256-038-040090_VR-Chain
cagguccagcucgucgaguccggcggcggcgucguccagcccggccgcucccuccgccucuccugcgccgccuccggcuucuccuucuccaacuacgccauggacuggguccgccaggcccccggcaagggccucgagugggucgccgucaucuccuccgacggcuccaacaagaacuacgccgacuccgucaagggccgcuucaccaucucccgcgacaacuccaagaacacccucuaccuccagauggacucccuccgcgccgacgacaccgccgucuacuacugcgccaaggaccucggcgaguccgagaacgaggagugggccaccgacuacuacgacuucuccaucggcuaccccguccaggacccccgcggcgucgucggcaucuucgacaucuggggccagggcaccauggucaccgucuccucc

SEQ ID NO: 17612 - RNA, 432 nt, Artificial Sequence
  derived and/or modified sequence opt2 from anti-HIV_cap256-038-032874_VR-Chain
cagguccagcucgucgaguccggcggcggcgucguccagcccggcggcucccuccgccucuccugcgccgccuccggcuucaccuucuccuccuacggcaugcacuggguccgccaggcccccggcaagggccucgagugggucgccuucauccgcuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaaggaggagugggccuccgacuacuacgacuucggccgcgacuaccccggccaggacccccgcggcgucgucggcaccuucgacaucuggggccacggcaccauggucaccgucuccucc

SEQ ID NO: 17613 - RNA, 432 nt, Artificial Sequence
  derived and/or modified sequence opt2 from anti-HIV_cap256-038-025899_VR-Chain
cagguccagcucgucgaguccggcggcggcgucguccagcccggccgcucccuccgccucuccugcgucgccuccggcuucaccuucuccaacuacgccauguacuggguccgccaggcccccggcaagggccucgagugggucaccaucaucuccuucgacggcuccaaccaguacuacgccgacuccgucaagggccgcuucaccaucucccgcgagaacuccaagaacacccucuaccuccagaugaacucccuccgcgccgaggacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17614 - RNA, 432 nt, Artificial Sequence
  derived and/or modified sequence opt2 from anti-HIV_cap256-038-024581_VR-Chain
cacauccagcucgucgaguccggcggcggcgucguccagcccggcggcucccuccgccucuccugcgccgccuccggcuuccccuucuccuccuucggcaugcacuggguccgccagacccccggccgcggccucgagugggucgccaucaucugguccgacggcucccacaaggaguacaccgacuccgucaagggccgcuucaccaucucccgcgacaacucccgcuccaccauggaccuccagaugaacaaccuccgccccgaggacaccgccgucuacuacugcgccaaggaccucggcgagcgcgagaacgaggagugggccuccgacuacuacgacuucggccgcgacuaccccggccaggacccccgcggcgucgucggcuccaucgacaccuggggccacggcaccauggucaccgucuccucc

SEQ ID NO: 17615 - RNA, 432 nt, Artificial Sequence
  derived and/or modified sequence opt2 from anti-HIV_cap256-038-013345_VR-Chain
cagguccagcucgucgaguccggcggcggcgucguccagcccggccgcucccuccgccucuccugcgccgucuccggcuucaccuucuccuccuacggcaugcacuggguccgccaggcccccggcaagggccucgagugggucgccgccaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgcccgcgaccucggcgagcgcgagaucgaggagugggccaccgacuacuacgacuucuccaucggcuaccccggccaggacccccgcggcgucgucggcgucuucgacaucuggggccagggcaccauggucaccgucuccucc

SEQ ID NO: 17616 - RNA, 438 nt, Artificial Sequence
  derived and/or modified sequence opt2 from anti-HIV_cap256-038-011559_VR-Chain
cagguccagcucgucgaguccggcggcggcgucguccagcccggccgcucccuccgccucuccugcgaggccuccggcuucaccuucuccuccuacggcauggacuggguccgccaggcccccggcaagggccucgagugggucgcccucaucucccacgacggcuccaacaagcacuacgccgacuccgucaagggccgcuucaccaucucccgcgacaacucccgcaacacccucuaccuccagaugaacucccuccgcgccgaggacaccgcccucuacuacugcgccaaggaccucggcgaguccgagaacgaggacgaggagugggccuccgacuacuacgacuucggccgcgacuaccccggccaggacucccgcggcgucgucggcaccuucgacauguggggccagggcaccauggucaccgucuccucc

SEQ ID NO: 17617 - RNA, 432 nt, Artificial Sequence
  derived and/or modified sequence opt2 from anti-HIV_cap256-038-009634_VR-Chain
cagguccagcucgucgaguccggcggcggcgucguccagcccggccgcucccuccgccucuccugcgccgccuccggcuucaccuucaccuccuucggcaugcacuggguccgccaggcccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcgccgaggacaccgccgucuaccacugcgccaaggaccucggcgaguccgagaucgaggaguggaccuccgacuacuacgacuucggccgcgacuaccccggccaggacccccgcggcgucuucggcaccuucgacaucuggggccacggcaccauggucaccgucuccucc

SEQ ID NO: 17618 - RNA, 432 nt, Artificial Sequence
  derived and/or modified sequence opt2 from anti-HIV_cap256-038-006730_VR-Chain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccaaggacggcuccgacaacuccuacgucgacuccgucaagggccgcuucaccaucucccgcgacaacuccaagaacacccucuaccuccagaugaacucccuccgcgccgaggacaccgccgucuacuacugcgcccgcgaccucggcgaguccgagaacgaggaguggcccuccgacuacuacgacuucggccgcgacuaccccggccaggacccccgcggcgucaucggcaccuucgacgucuggggccagggcaccauggucaccgucuccucc

SEQ ID NO: 17619 - RNA, 432 nt, Artificial Sequence
  derived and/or modified sequence opt2 from anti-HIV_cap256-038-004887_VR-Chain
cagguccagcucgucgaguccggcggcggcgucguccagcccggccgcucccuccgccucuccugcgccgccuccggcuucuccuucuccaccuccggcaugcacuggguccgccaggcccccggcaagggcauggagugggucgccgucaucuccuacgacggcuccaacaaguacuacgccgacuccgucaagggccgcuucaccaucucccgcgacaacuccaagaacacccucuaccuccagaugaacucccuccgcgccgucgacaccgccgucuacuacugcgccaaggaccucggcgagggcgagaacgaggagugggccaccgacuacuacgacuucuccaucggcuaccccguccagaacccccgcggccucgucggcgccuucgacaucuggggccagggcaccauggucaccgucuccucc

SEQ ID NO: 17620 - RNA, 432 nt, Artificial Sequence
  derived and/or modified sequence opt2 from anti-HIV_cap256-038-004840_VR-Chain
cagguccagcucgucgaguccggcggcggcgucguccagcccggccgcucccuccgccucuccugcgccgccuccggcuucaccuucuccuccuucggcaugcacuggguccgccagucccccggcaagggccucgagugggucgccgucaucuccuacgacggcaacaacaaguacuacgccgacuccgucaagggccgcuucaccaucucccgcgagaacuccaagaacacccucuaccuccagaugaacucccuccgcaccgacgacaccgccgucuacuacugcgccaaggaccucggcgaguccgagaccgaggaguggcccuccgacuacuacgacuucggccgcgacuaccccggccaggacccccgcggcgucgucggcaccuucgacaucuggggccacggcaccauggucaccgucuccucc

SEQ ID NO: 17621 - RNA, 432 nt, Artificial Sequence
  derived and/or modified sequence opt2 from anti-HIV_cap256-038-002181_VR-Chain
gagguccagcucgucgaguccggcggcggccucguccagcccggccgcucccuccgccucuccugcgccgccuccggcuucaccuucgaggacuacgccaugcacuggguccgccaggcccccggcaagggccucgagugggucgccgucaucuccuacgacggcuccaacaaguacuacgucgacuccgucaagggccgcuucaccaucucccgcgacaacuccaagaacacccucuaccuccagaugaacucccuccgcgccgaggacaccgccgucuacuacugcgccaaggaccucggcgaguccgagaacgaggagugggccaccgacuacuacgacuucuccaucggcuaccccggccaggacccccgcggcgucgucggcaucuucgacaucuggggccagggcaccauggucaccgucuccucc

SEQ ID NO: 17622 - RNA, 432 nt, Artificial Sequence
  derived and/or modified sequence opt2 from anti-HIV_cap256-038-001902_VR-Chain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccuacgacggcaacaacaaguacuacgccgacuccgucaagggccgcuucaccaucucccgcgagaacuccgagaacacccucuaccuccagaugaacucccuccgcgccgacgacaccgccgucuacuacugcgccaaggaccucggcgaguccgagaacgaggagugggccuccgacuacuacgacuucggccgcgacuaccccggccaggacacccgcggcgucgucggcaccuucgacaucuggggccacggcaccauggucaccgucuccucc

SEQ ID NO: 17623 - RNA, 432 nt, Artificial Sequence
  derived and/or modified sequence opt2 from anti-HIV_cap256-038-000976_VR-Chain
cagguccagcucgucgaguccggcggcggcgucguccagcccggccgcucccuccgccucuccugcgccgccuccggcuucaccuucuccuccuucggcaugcacuggguccgccaggcccccggcaagggccucgagugggucgccgucaucuccgacgacggcaacaacaaguacuacgccgacuccgucaagggccgcuucaccaucucccgcgacaacuccaagaacacccucuaccuccagaugaacucccuccgcgucgaggacaccgccgucuacuacugcgucaaggacgucggcgaguccgagaacgaggagugggccuccgacuacuacgacuucggccgcgacuaccccggccaggacacccgcgccgucgucggcgccuucgacaucuggggccagggcaccauggucaccgucuccucc

SEQ ID NO: 17624 - RNA, 432 nt, Artificial Sequence
  derived and/or modified sequence opt2 from anti-HIV_cap256-038-000384_VR-Chain
cagguccagcucgucgaguccggcggcggcgucguccagcccggcaagucccuccgccucuccugcgccgccuccggcuucaccuucuccuccuacgucaugcacuggguccgccaggcccccggcaagggccucgagugggucgccgacaucuccuacgacggcuccaacaaguacuacgccgacuccgucaagggccgccucaccaucucccgcgacaacuccaagaacacccucuaccuccagaugaacucccuccgcgccgaggacaccgccgucuacuacugcgucaaggaccucggcgaguccgagaaggaggaguggcccuccgacuacuacgacuucggccgcgacuaccccggccaggacucccgcggcgucgucggcgucuucgacaucuggggccagggcaccauggucaccgucuccucc

SEQ ID NO: 17625 - RNA, 321 nt, Artificial Sequence
  derived and/or modified sequence opt2 from anti-HIV_206-314431_VR-Chain
caguucguccucacccagccccccuccgucuccgccgcccccggccagaacgucaccaucuccugcuccggcccccccucccacaucgagaagaacgacgucuccugguaccagcgccuccccggcauggcccccaagauggucaucuacgagucccgccgccgcccccucggcauccccguccgcuucaccgccucccgcuccggcuccuccgccacccucgucaucaccggccuccagaccgccgacgaggccgacuacuacugcggcaccugggacggccgcaugaacuucggcaccggcaccaccgucaccguccuc

SEQ ID NO: 17626 - RNA, 321 nt, Artificial Sequence
  derived and/or modified sequence opt2 from anti-HIV_206-247594_VR-Chain
caguccauccucacccagccccccuccgucuccgccgcccccggccagaacgucaccaucuccugcuccggcccccccucccacaucgagaagaacgacgucuccugguaccagcgcuuccccggcauggcccccaagaugaucaucuacgaguccaagcgccgccccuucggcguccccggccgcuucuccgccucccgcuccggcaaguccgccacccucgccaucaccggccuccagaccggcgacgaggccgacuacuacugcggcaccugggacggccgcaugaacuucggcaccggcaccaccgucaccguccuc

SEQ ID NO: 17627 - RNA, 321 nt, Artificial Sequence
  derived and/or modified sequence opt2 from anti-HIV_206-116890_VR-Chain
caguccguccucacccagccccccuccgucuccgccgcccccggccagaacgucaccaucuccugcuccggcccccccucccacaucgagaagaacgacgucuccugguaccagcaccuccccggcgaggcccccaagaugaucaucuacgaguccuggcgccgccccgccggcauccccgcccgcuucuccgccucccgcuccggcaaguccggcacccucgccaucaccggccuccagaccggcgacgaggccgacuacuacugcggcaccuggaacggccgcaugaacuucggcaccggcaccaccgucaccguccuc

SEQ ID NO: 17628 - RNA, 333 nt, Artificial Sequence
  derived and/or modified sequence opt2 from anti-HIV_206-072383_VR-Chain
caguccguccucacccagccccccuccgucuccgccgcccccggccagcgcgucaucaucuccugcuccggcaacaacuccaccaucggcaacaacuucgucuccugguaccagcagguccccggcaccgcccccaagcuccucaucuacgagaccaaccgccgccccuccggcauccccgaccgcuucuccggcuccaaguccggcaccuccgccacccucgccaucuccggccuccagaccggcgacgaggccgacuucuacugcaccgucuggggcguccgcaagggcgucgccgccgucuucggcaccggcacccgccucaccguccuc

SEQ ID NO: 17629 - RNA, 333 nt, Artificial Sequence
  derived and/or modified sequence opt2 from anti-HIV_206-037527_VR-Chain
caguccguccucacccagccccccuccgucuccgccgcccccggccagaaggucaucaucuccugcuccggcaacaacuccaccaucggcaagauccucgucuccugguaccagcagguccccggcaccgcccccaagcucgucaucuacgagaccaaccgccgccccuccggcauccccgaccgcuucuccggcuccaaguccggcaccuccgccacccucgccaucaccggccuccagaccggcgacgaggccgacuacuucugcaaggucuggggcguccgcaagggcgucgccgccgucuucggcaccggcaccaaggucaccguccuc

SEQ ID NO: 17630 - RNA, 333 nt, Artificial Sequence
  derived and/or modified sequence opt2 from anti-HIV_206-009095_VR-Chain
caguccguccucacccagccccccuccgucuccgccgcccccgcccagcgcgucaucaucuccugcuccggcgacaacuccaccaucggcaacaacuucgucuccugguaccagcagguccccggcgccgcccccaagcuccucaucuacgagaccaaccgccgccccuccggcauccccgaccgcuucuccggcuccaaguccggcaccaccgccacccucgccaucuccggccuccagaccggcgacgaggccgacuaccacugcaccgucuggggcguccgcaagggcgucgccgccgucuucggcaccggcaccaaggucaccguccuc

SEQ ID NO: 17631 - RNA, 321 nt, Artificial Sequence
  derived and/or modified sequence opt2 from anti-HIV_176-503620_VR-Chain
caguccguccucacccagccccccuccgucuccaccgcccccggccagaccgucaccgucuccugcuccggcggcaccuccaacaccggcaacaacuucgucuccugguaccagcaccuccccggcaccgcccccaagcuccucaucuacgagaacaacaagcgcccccucggcguccccgaccgcuucuccggcgccaaguccggcaccuccgccacccucgcccucaccggccuccagaccggcgacgagggcgacuacuacugcgccaccugguccggcucccucaacaucggcaccggcaccaaggucuccguccuc

SEQ ID NO: 17632 - RNA, 321 nt, Artificial Sequence
  derived and/or modified sequence opt2 from anti-HIV_176-478726_VR-Chain
caguccguccucacccagccccccuccgucuccgccgcccccggccagaacgucaacaucuccugcuccggcccccccucccacaucgagcgcaacgacgucuccugguaccagcaccuccccggcgccgcccccaagaugaucaucuacgaguccuggcgccgccccgccggcauccccgaccgcuucuccgccucccgcuccggcgccuccgccacccucgccaucaccggccuccagaccggcgacgaggccgacuacuacugcggcaccuggaacggccgcaugaacuucggcaccggcaccaccgucaccguccuc

SEQ ID NO: 17633 - RNA, 321 nt, Artificial Sequence
  derived and/or modified sequence opt2 from anti-HIV_176-245056_VR-Chain
caguccguccucacccagccccccuccgucuccgccgcccccggccagaacgucaccaucuccugcuccggcccccccucccacaucgagaagaacggcgucuccugguaccagcaguuccccggcauggcccccaagauggucaucuacgaguccaagcgccgccccuucggcguccccgcccgcuucuccgccucccgcuccggcaaguccgccacccucgccaucaccggccuccagaccggcgacgaggccgacuacuacugcggcaccugggacggccgcaugaacuucggcaccggcaccaccgucaccguccuc

SEQ ID NO: 17634 - RNA, 321 nt, Artificial Sequence
  derived and/or modified sequence opt2 from anti-HIV_176-164413_VR-Chain
caguccguccucacccagccccccuccgucuccgccgcccccggccagaaggucaccaucuccugcuccggcggcaccuccaacaucggcaacaacuacgucuccugguaccagcgccuccccggcaccgcccccaagcuccucaucuacgagaacaacaagcgccccuccggcauccccgaccgcuucuccggccccaaguccggcaccuccgccacccucgccaucaccggccuccagcccggcgacgaggccgacuacuacugcgccaccugguccggcucccucaacuucggcaccggcaccaaggucaccguccuc

SEQ ID NO: 17635 - RNA, 333 nt, Artificial Sequence
  derived and/or modified sequence opt2 from anti-HIV_176-094308_VR-Chain
caguccguccucacccagccccccuccgucuccgccgcccccggccagaaggucaucaucuccugcuccggcaacaacuccaccaucggcaacaacuucgucuccugguaccagcagguccccggcaccgcccccaagcuccucgucuacgagaccuaccgccgccccuccggcauccccgaccgcuccuccggcuccaaguccggcaccaccgccacccaggccaucuccggccuccagaccggcgacgaggccgacuaccacugcaccgucuggggcguccgcaagggcgucgccgccgucuucggcaccggcaccaaggucaccguccuc

SEQ ID NO: 17636 - RNA, 333 nt, Artificial Sequence
  derived and/or modified sequence opt2 from anti-HIV_176-065321_VR-Chain
caguccguccucacccagccccccuccgucuccgccgcccccggccgccgcgucaucaucuccugcuccggcaacaacuccaccaucggcaacaacuucgucuccugguaccagcagguccccggcaccgcccccaagcuccucgucuacgagaccaaccgccgccccuccggcauccccgaccgcuucuccggcuccaaguccggcaccuccgccacccucgccaucuccggccuccagaccggcgacgaggccgacuacuacugcaccgucuggggcguccgcaagggcgucgccgccgucuucggcaccggcaccaaggucaccguccuc

SEQ ID NO: 17637 - RNA, 324 nt, Artificial Sequence
  derived and/or modified sequence opt2 from anti-HIV_119-099719_VR-Chain
caguccguccucacccagccccccuccgucuccgccgcccccggccagaaggucaccaucuccugcuccggcuccaacuccuacaucggcaacaaguacaucuccugguaccagcaguuccccggcaccgcccccaagcuccucaucuacgagaacaacaagcgccccuccggcguccccgaccgcuucuccgccuccaaguccgccaccuccgccacccucgccaucaccggccuccacaccggcgacgaggccgacuacuacugcgagaccugcgacggcuccggcggcgucuucggcaccggcaccaaggucaccguccuc

SEQ ID NO: 17638 - RNA, 327 nt, Artificial Sequence
  derived and/or modified sequence opt2 from anti-HIV_119-099536_VR-Chain
gagcucacccagccccccuccgucuccgccgccuccggccagaacgucaacaucuccugcuccggcggcuccuccaacaucggcuccaacuacgucuccugguaccagcaguuccccggcaccgcccccaagcuccucaucuacgagaccaacaagcgccccuccggcauccccgaccgcuucuccggcuccaaguccggcgccuccgccacccucgccaucaccggccuccagaccggcgacgaggccgacuacuacugcgccaccugggccgacucccucaacuccgcccgcgucuucggcaccggcaccaaggucaccguccuc

SEQ ID NO: 17639 - RNA, 333 nt, Artificial Sequence
  derived and/or modified sequence opt2 from anti-HIV_119-098907_VR-Chain
caguccguccucacccagccccccuccgucuccgccacccccggccagaaggucaccaucuccugcuccggcuccaacuccaacaucggcgacaaguacgucuccugguaccagcacuuccccggcaccgcccccaagcuccucgucuacgagaccuaccgccgccccuccggcauccccgaccgcuucuccggcuccaaguccggcaccuccgccacccucgccaucaccggccuccagaccggcgacgaggccgacuacuacugcaccaucuggggcguccgcaagggcgucggcgccgucuucggcaccggcaccaaggucaucguccuc

SEQ ID NO: 17640 - RNA, 324 nt, Artificial Sequence
  derived and/or modified sequence opt2 from anti-HIV_119-098555_VR-Chain
caguccguccucacccagccccccuccgucuccgccgcccccggccagaacgucaccaucuccugcuccggcuccgccuccaacaucggcaagaacuucgucuccugguaccagcagcuccccggcaccgcccccaagcuccucaucuacggcuccaacaaccgccccuccggcguccccgaccgcuucuccggcuccaaguccggcaccuccgccucccucgccaucaccggccuccagaccggcgacgaggccgacuacuacugcgagaccugggacggcuccggcgccgucuucggcaccggcaccaaggucaccguccuc

SEQ ID NO: 17641 - RNA, 324 nt, Artificial Sequence
  derived and/or modified sequence opt2 from anti-HIV_119-097828_VR-Chain
caguccguccucacccagccccccuccgucuccgccgcccccggccagaaggucaccaucuccugcuccggcuccuccuccaacaucggcaagaacuacgucuccugguaccagcuccuccccggcaccgccccccgccucgucaucuacgagaacgacgagcgccccuccggcacccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17642 - RNA, 324 nt, Artificial Sequence
  derived and/or modified sequence opt2 from anti-HIV_119-096480_VR-Chain
caguccguccucacccagccccccuccgucuccggcgcccccggccagcgcaucaccaucuccugcuccggcuccaccuccaacaucggccagaacuacgucuccugguaccagcagcuccccggcaccgcccccaagcuccucaucuccgacaacaaccgccgccccuccuggacccccgaccgcuucuccggcuccaaguccggcaccuccgccacccucgccaucaccggccuccagaccggcgacgaggccgacuacuacugcgagaccugggacggcuccggcggcgucuucggccccggcacccgcgucaccguccuc

SEQ ID NO: 17643 - RNA, 324 nt, Artificial Sequence
  derived and/or modified sequence opt2 from anti-HIV_119-095664_VR-Chain
caguccguccucacccagccccccuccgucuccgccgcccccggccagaaggucaccaucuccugcuccggcggcgccgccaacaucggcaagaacuccgucuccugguaccagcagcuccccggcaccgcccccaagcuccucaucuacgacaacaaccgccgccccuccggcacccccgaccgcuucuccggcuccaaguccggcaccuccgccacccucgccaucuccggccuccagaccggcgacgaggccgacuacuacugcgagaccuggcacggcuccggcggcgucuucggcaccggcaccaaggucaccguccuc

SEQ ID NO: 17644 - RNA, 321 nt, Artificial Sequence
  derived and/or modified sequence opt2 from anti-HIV_119-095212_VR-Chain
caguccguccucacccagccccccuccgucuccgccgcccccggccagaaggucaccaucuccugcuccggcuccaccuccaacaucggcaaguccgacgucuucugguaccagcagcuccccggcaccgcccccaagcuccucaucuccgagaccucccgccgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17645 - RNA, 333 nt, Artificial Sequence
  derived and/or modified sequence opt2 from anti-HIV_119-094773_VR-Chain
caguccguccucacccagucccccaccgucuccgccgcccccggccagaccgucaccaucuccugcuccggcggcaccuccaacgucggcaagaacuucgucuccugguaccagcaguucccccgcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17646 - RNA, 324 nt, Artificial Sequence
  derived and/or modified sequence opt2 from anti-HIV_119-094508_VR-Chain
caguccguccucacccagccccccuccgucuccgccacccccggccagcgcgucaccgucuccugcuccggcuccuccuccaacaucggcaaccacuacgucuccugguaccagcagguccccggcaccgcccccaagcuccucaucuccgagaacucccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17647 - RNA, 324 nt, Artificial Sequence
  derived and/or modified sequence opt2 from anti-HIV_119-093795_VR-Chain
caguccguccucacccagccccccuccgucuccgccgcccccggccagaaggucaccaucuccugcuccggcuccuccuccaacaucggcaacaacuacgucuccugguaccaguaccuccccggcaccgcccccaagcuccucaucuccgagaacaaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17648 - RNA, 321 nt, Artificial Sequence
  derived and/or modified sequence opt2 from anti-HIV_119-093732_VR-Chain
caguccguccucacccagccccccuccgucuccgccgccgccggccagaacgucaacaucuccugcuccggccgcaaguccaacgucggcggcaacuacgucuccugguaccagcaguuccccggcaccgcccccaagcuccucaucuacgaggacaacaagcgccccuccuggauccccgaccgcuucaccgccucccgcuccggcaccuccgccacccucggcaucaccggccuccagaccggcgacgaggccgacuacuucugcuccaccugguccggcucccucaacuucggcaccggcacccgcgucaccguccuc

SEQ ID NO: 17649 - RNA, 333 nt, Artificial Sequence
  derived and/or modified sequence opt2 from anti-HIV_119-092903_VR-Chain
caguccguccucacccagccccccuccgucuccgccgccccccgccagaaggucaccaucuccugcuccggcuccuccuccaacaucggcaaccacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17650 - RNA, 333 nt, Artificial Sequence
  derived and/or modified sequence opt2 from anti-HIV_119-092284_VR-Chain
caguccguccucacccagccccccuccgucuccggcgcccccggccagcgcgucaccaucuccugcaccggcuccuccuccaacaucggcggcuacgacguccacugguaccagcagguccccggcaccgcccccaagcuccuccucuacgagaacgaccgccgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17651 - RNA, 333 nt, Artificial Sequence
  derived and/or modified sequence opt2 from anti-HIV_119-091586_VR-Chain
caguccguccucacccagccccccuccauguccgccgcccccggccagcgcgucaccaucuccugcuccggcaccuccuccgacaucggccgcaacuacgucuccugguaccagcaguuccccggcgccgcccccaagguccucaucuacgagaacuccaaccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggcgccggcaccaaggucaccguccuc

SEQ ID NO: 17652 - RNA, 333 nt, Artificial Sequence
  derived and/or modified sequence opt2 from anti-HIV_119-091023_VR-Chain
caguccguccucacccagccccccuccgucuccgccgcccccggccagcgcgucaccaucuccugcuccggcuccaccuccaacaucggcaacaacuucgucuccugguaccaccacguccccggcaccgcccccaagcuccucaucuacgacaacgucaagcgccccaccaacguccccgaccgcuucuccggcuccaaguccggcaccuccgccacccucgccaucuccggccuccagaccggcgacgaggccgacuacuggugcgccgucuggggcguccgccgcggcgccggcgccgucuucggcgccggcaccaaggucaccguccuc

SEQ ID NO: 17653 - RNA, 333 nt, Artificial Sequence
  derived and/or modified sequence opt2 from anti-HIV_119-090334_VR-Chain
caguccguccucacccagccccccuccgucuccggcgcccccggccagcgcgucaccaucuccugcaccggcuccgccuccaacaucggcgacuccgacguccacugguaccagcagcuccccggcaccgcccccaagcuccucaucuucgacaacgacaagcgccccuccggcauccccgaccgcuucuccggcuccaaguccggcaccuccgccacccucgccaucaccggccuccaguccggcgacgaggccgacuacuacugcgccgucuggggcguccgccagggcgccggcgccgucuucggcaccggcaccaaggucaccguccuc

SEQ ID NO: 17654 - RNA, 333 nt, Artificial Sequence
  derived and/or modified sequence opt2 from anti-HIV_119-088694_VR-Chain
caguccguccucacccagccccccuccgucuccgccgcccccggccagaaggucaccaucuccugcuccggcuccuccuccaacauccccaucaacggcgucuccugguaccagcaguuccccggcaccgcccccaagcuccucgucuacgagaccuaccgccgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17655 - RNA, 333 nt, Artificial Sequence
  derived and/or modified sequence opt2 from anti-HIV_119-088499_VR-Chain
caguccguccucacccagccccccuccgucuccgccgcccccggccagaaggucaccaucuccugcuccggcuccaacuccuacaucggcaacaaguacgucuccugguaccagcaguuccccggcaccgcccccaagcuccucaucuacgagaccaacaagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17656 - RNA, 333 nt, Artificial Sequence
  derived and/or modified sequence opt2 from anti-HIV_119-088298_VR-Chain
caguccguccucacccagccccccuccgucuccgccgcccccaaggagaaggucaccaucuccugcuccggcggcaccuccaacaucggccgcaacuacgucuccugguaccagcagguccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccuggggcggcucccuccgcaccggcggcguccucggcaccggcacccgcgucaccguccuc

SEQ ID NO: 17657 - RNA, 324 nt, Artificial Sequence
  derived and/or modified sequence opt2 from anti-HIV_119-087488_VR-Chain
caguccguccucacccagccccccuccgucuccgccgcccccggccagaaggucaccaucuucugcuccggccgcuacuccaacaucgaguccaacuacgucuccugguaccagcagcuccccggcaccgcccccaagcuccucauccacgagaacaaccgccgccccuccggcacccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17658 - RNA, 333 nt, Artificial Sequence
  derived and/or modified sequence opt2 from anti-HIV_119-087423_VR-Chain
caguccguccucacccagccccccuccgucuccgccgcccccggccagaaggucaccaucuccugcuccgccuccuccuccaacaucggcaacaacuacgucuccugguaccagcagcuccccgccaccgcccccaagcuccucaucuacgacaccgacaagcgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17659 - RNA, 324 nt, Artificial Sequence
  derived and/or modified sequence opt2 from anti-HIV_119-087371_VR-Chain
caguccguccucacccagccccccucccucuccgccgcccccggccagcgcgucaccaucuccugcuccggcggcgccuccaacaucggcaagaacuccgucuccugguacguccagguccccggcaccgcccccaagcuccucaucuacgagaacaaccagcgccccuccggcaucuccgaccgcuucuccggcuccaaguccggcuccuccgccacccucggcaucaccggccuccagaccgccgacgaggccgacuacuacugcgagaccugggacggcuccggcggcgucuucggcaccggcaccaaggucaccguccuc

SEQ ID NO: 17660 - RNA, 321 nt, Artificial Sequence
  derived and/or modified sequence opt2 from anti-HIV_119-087279_VR-Chain
caguccguccucacccagccccccuccgucuccgccgcccccggccagaaggucaccaucuccugcuccggcuccuccuccaacaucggcaagaacuacgucuccugguaccagcaguuccccggcaccgcccccaagcuccucauguacgagaacaacaagcgccccuccggcguccccgaccgcuucuccggcuccaaguccggcaccuccgccacccucgacaucuccggccuccagaccggcgacgaggccgacuacuacugcuccaccugguccggcucccucaacuucggcaccggcacccgcgucaccguccuc

SEQ ID NO: 17661 - RNA, 324 nt, Artificial Sequence
  derived and/or modified sequence opt2 from anti-HIV_119-087146_VR-Chain
caguccguccucacccagccccccuccgucuccgccgcccccggccagaaggucaccaucuccugcuccggcuccuccuccaacaucggcaagaacuccgucuccugguaccagcaguuccccggcaccgcccccaagcuccucaucuacgagaacaacaagcgccccuccggcauccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17662 - RNA, 324 nt, Artificial Sequence
  derived and/or modified sequence opt2 from anti-HIV_119-087048_VR-Chain
caguucguccucacccagccccccuccgucuccgccgccccccgccagaaggucaucaucuccugcuccggcuccuccuccaacaucggcaagaacuacgucuccugguaccagcagcuccccggcaccgcccccaagcuccucaucuacgacaacgacaagcgccccuccggcaucuccgaccgcuucuccgccuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17663 - RNA, 321 nt, Artificial Sequence
  derived and/or modified sequence opt2 from anti-HIV_119-085802_VR-Chain
caguccauccucacccagccccccuccgucuccgccgcccccggccagcgcgucaccauccccugcuucggcggccacuccaacaucggcuccaacuacgucuccugguaccagcaccuccccggcaccgcccccaagcuccucaucuucgagaacaacaagcgccccuccggcauccccgaccgcuucuccggcgccaaguccggcaccuccgccacccucgccaucaccggccuccagaccggcgacgaggccgacuacuucugcgccaccugguccggcggccucaacuucggcaccggcaccaaggucaccguccuc

SEQ ID NO: 17664 - RNA, 324 nt, Artificial Sequence
  derived and/or modified sequence opt2 from anti-HIV_119-085784_VR-Chain
caguccuuccucacccagccccccuccgucuccgccgcccccggccagaaggucaccaucuccugcuccggcuccaacuccaacaucggcaacaacuacgucuccugguaccaguaccuccccggcaccgcccccaagcuccucaucuacgagaacgaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17665 - RNA, 333 nt, Artificial Sequence
  derived and/or modified sequence opt2 from anti-HIV_119-085370_VR-Chain
caguccguccucacccagccccccuccgucuccgccgcccccggccagaccgucaccaucuccugcuccggcuccuccuccaacaucggcaacaccuacgucuccugguaccagcaccuccccggcaccgcccccaagcuccucaucuacgacaacaacauccgccccuccggcauccccgaccgcuucuccgccuccaaguccggcaccuccgccacccucgccaucaccggccuccagaccggcgacgaggccgacuacuacugcgccaccugggcccccucccucaacuccgcccgcgucuucggcuccggcacccgcgucgccguccuc

SEQ ID NO: 17666 - RNA, 321 nt, Artificial Sequence
  derived and/or modified sequence opt2 from anti-HIV_119-085276_VR-Chain
caguccauccucacccagccccccuccgucuccgccgcccccggccagcgcgucaccaucuccugcuccggcuccuccuccaacaucggcaacaacuacgucuccugguaccagcacguccccggcaccgcccccaagcuccucaucuacgagaacaaccgccgccccuccggcacccccgaccgcuucuccggcgccaaguccggcaccuccgccacccucgccaucaccggccuccagaccggcgacgaggccgacuacuucugcuccaccugguccggcucccucaacuucggcaccggcaccaaggucaccguccuc

SEQ ID NO: 17667 - RNA, 333 nt, Artificial Sequence
  derived and/or modified sequence opt2 from anti-HIV_119-084885_VR-Chain
caguccguccucacccagccccccuccgucuccgccgcccccggcgagaaggucaccaucuccugcuccggcuccuccuccaagaucggcaacaacuucgucuccugguaccagcagguccccggcaccgcccccaagcuccucgucuacgaguccuaccgccgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17668 - RNA, 333 nt, Artificial Sequence
  derived and/or modified sequence opt2 from anti-HIV_119-084874_VR-Chain
caguccguccucacccagccccccuccgucuccggcgccccccgccagcgcgucaccaucuccugcuccggcuccgccuccaacaucggcaagaacuccgucuccugguaccagcagguccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17669 - RNA, 333 nt, Artificial Sequence
  derived and/or modified sequence opt2 from anti-HIV_119-084691_VR-Chain
caguccguccucacccagccccccuccgucuccgccgcccccggccagaaggucgucaucuccugcuccggcuccuccuccaucaucgagaagaacuccaucuccugguaccagcagggccccggcgccgcccccaagcuccucaucuacgagaacgacaagcgccccuccggcauccccgaccgcuucuccggcuccaaguccgccaccuccgccacccucgccaucgucggccuccagaccggcgacgaggccgacuacugcugcgccgucuggggcguccgccgcggcgccggcgccgucuucggcgccggcaccaaggucaccguccuc

SEQ ID NO: 17670 - RNA, 324 nt, Artificial Sequence
  derived and/or modified sequence opt2 from anti-HIV_119-083793_VR-Chain
caguccguccucacccagccccccuccgucuccgccgcccccggccagaaggucaccaucuccugcuccggcuccuccuccaacaucggcaagaacuccgucuccugguaccagcagcuccccgccaccgcccccaagcuccucaucuacgaguccaacaagcgccccuccggcauccccgaccgcuucuccggcuccaaguccggcaccuccgccacccucgccaucaccggccuccagaccggcgacgaggccgacuacuacugcgccaccugggacggccgcgucuccgucaucggcaccggcaccaaggucaccguccuc

SEQ ID NO: 17671 - RNA, 324 nt, Artificial Sequence
  derived and/or modified sequence opt2 from anti-HIV_119-083163_VR-Chain
caguccguccucacccagccccccuccgucuccggcgcccccggccagcgcgucaucaucuccugcaccggcuccuccuccaacaucuggggcuacgacguccagugguaccagcagcuccccggcaccgcccccaagcuccuccucuacgagaacgaccgccgccccuccggcacccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17672 - RNA, 333 nt, Artificial Sequence
  derived and/or modified sequence opt2 from anti-HIV_119-082331_VR-Chain
caguccguccucacccagccccccuccaucuccgccgcccccggccagaaggucaccaucuccugcuccggcggcuccuccaacaucggcgccaacuacgucuccugguaccagcaccuccccggcaccgcccccaagcuccucaucuacgagaccaacaagcgccccuccggcauccccgaccgcuucuccggcucccaguccggcaccuccgccacccucgucaucaccggccuccagaccggcgacgaggccgacuucuacugcggcaccuggggcggcucccuccgcgccggcggcgucaucggcaccggcacccgcgucaccguccuc

SEQ ID NO: 17673 - RNA, 324 nt, Artificial Sequence
  derived and/or modified sequence opt2 from anti-HIV_119-082070_VR-Chain
caguccguccucacccagccccccuccgucuccgccgcccccggccagaaggucgucaucuccugcuccggcuccuccuccaucaucgagaagaacuccaucuccugguaccagcagggccccggcgccgcccccaagcuccucaucuacgagaacgaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17674 - RNA, 333 nt, Artificial Sequence
  derived and/or modified sequence opt2 from anti-HIV_119-081512_VR-Chain
caguccguccucacccagccccccuccgucuccgccgcccccggccagaacgucaccuucuccugcuccggcuccaacuccaacaucggcgacaacuacgucuccugguaccagcagauccccggcaccgcccccaagcucgucaucuacgacaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17675 - RNA, 333 nt, Artificial Sequence
  derived and/or modified sequence opt2 from anti-HIV_119-080816_VR-Chain
cagcucguccucacccagccccccuccgccuccggcacccccggccagcgcgucaccaucuccugcuccggcuccuccuccaacaucggcuccaacuucgucuccugguaccagcagcgccccggcaccgcccccaagcuccucaucuacgagaccaacaagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17676 - RNA, 333 nt, Artificial Sequence
  derived and/or modified sequence opt2 from anti-HIV_119-079302_VR-Chain
caguccguccucacccagccccccuccgucuccgccgcccccggccagaaggucaccaucuccugcuccggcuccuccuccuacaucggcaacaaguacgucuccugguaccagcaguuccccggcaccgcccccaagcuccucaucuacgagaacaacaagcgccucuccggcauccccgaccgcuucuccgccuccaaguccgccaccuccgccacccucgccaucuccggccuccagaccggcgacgaggccgacuucuacugcggcaccugggacggcucccuccgcaccggcggcgucaucggcaccggcacccgcgucaccguccuc

SEQ ID NO: 17677 - RNA, 327 nt, Artificial Sequence
  derived and/or modified sequence opt2 from anti-HIV_119-079292_VR-Chain
caguccguccucacccagccccccuccgucuccgccgcccccggccagaaggucaccaucuccugcuccggcuccaacuccaacaucggcaacaacuacgucuccugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccaacuacuacugcggcaccugggacaccucccucuccggcgucuucggcaccggcaccgaggucaucguccuc

SEQ ID NO: 17678 - RNA, 321 nt, Artificial Sequence
  derived and/or modified sequence opt2 from anti-HIV_119-079289_VR-Chain
caguccgcccucacccagccccccuccgucuccgccgcccccggccagcgcgucaccaucuccugcuccggcaacaacuccaacaucggcaacaacuucgucuccugguaccagcuccuccccggcaccgcccccaagcuccucaucuacgagaacaacaagcgcuccuccggcauccccgaccgcuucuccggcuccaaguccggcaccuccgccacccucggcaucaccggccuccagaccggcgacgaggccgacuacuucugcuccaccugguccggcucccucaacuucggcaccggcacccgcgucaccguccuc

SEQ ID NO: 17679 - RNA, 324 nt, Artificial Sequence
  derived and/or modified sequence opt2 from anti-HIV_119-078935_VR-Chain
caguccguccucacccagccccccuccgucuccgccgcccccggccagcgcgucaccaucuccugcuccggcaccuccgccaacaucgagaacuacuacgucuccugguaccagcagcuccccggcaccgcccccaagcucaucaucuacgacgacaacaagcgccccuccggcaucccccagcgcuucuccggcuccaaguccggcaccuccgccacccucggcaucaccggccuccagaccggcgacgaggccgaguacuacugcgagaccugggacggcuccggcggcgucuucggcaccggcaccaaggucaccguccuc

SEQ ID NO: 17680 - RNA, 324 nt, Artificial Sequence
  derived and/or modified sequence opt2 from anti-HIV_119-078702_VR-Chain
caguccguccucacccagccccccuccgucuccgccgcccccggccagaaggucaccaucuccugcuccggcuccuccuccgucuucggcaagaacuacgucuccugguaccagcaccuccccggcaccgcccccaagcuccucaucuacgagaacaccaagcgccccuccggcauccccgaccgcuucuccggcuccaaguccggcaccuccgccacccucgccaucaccggccuccagaccggcgacgaggccgacuacuacugcgagaccugggacggcuccggcggcgucuucggcuccggcaccaaggucaccguccuc

SEQ ID NO: 17681 - RNA, 324 nt, Artificial Sequence
  derived and/or modified sequence opt2 from anti-HIV_119-078593_VR-Chain
caguccuuccucacccagccccccuccgucuccgccgcccccggccagaaggucaccaucuccugcuccggcuccaacuccaacaucggcaacaacuacgucuccugguaccagcagguccccggcaccgcccccaagcuccucaucuacgagaacaacaagcgccccuccggcauccccgaccgcuucuccggcuccaaguccggcaccuccgccacccucgucaucaccggccuccacaccggcgacgaggccgacuacuacugcgagaccugggacggcuccggcggcgucuucggcaccggcuccaacgucacccuccuc

SEQ ID NO: 17682 - RNA, 333 nt, Artificial Sequence
  derived and/or modified sequence opt2 from anti-HIV_119-077708_VR-Chain
caguccguccucacccagccccccucccucuccgccgcccccggccagaaggucaccaucuccugcuccggcaccaccuccaacaucggcaacaacuacgucuccugguaccagcaccuccccggcaccgcccccaagcuccucaucuacgagaacaccaagcgccccuccggcauccccgaccgcuucuccggcuccaaguccggcaccuccgccacccucggcaucaccggccuccagaccggcgacgaggccgacuacuacugcaccgucuggggcguccgcaagggcgucggcgccgucuucggcaccggcaccaaggucaccguccuc

SEQ ID NO: 17683 - RNA, 321 nt, Artificial Sequence
  derived and/or modified sequence opt2 from anti-HIV_119-076904_VR-Chain
caguccguccucacccagccccccuccgucuccgccgcccccggccagaaggucaccaucuccugcucccgcuccuccucccacaucgagaacuccuacgucuccugguaccagcaccuccccggcaccgcccccaagcuccucaucuacgagaacaacaagcgccccuccggcauccccgaccgcuucuccggcuccaaguccggcaccuccgccacccucggcaucuccggccuccagaccggcgacgaggccgacuacuucugcuccaccugguccggcucccucaacuucggcaccggcacccgcgucaccguccuc

SEQ ID NO: 17684 - RNA, 324 nt, Artificial Sequence
  derived and/or modified sequence opt2 from anti-HIV_119-075862_VR-Chain
caguccguccucacccagccccccuccaucuccgccgcccccggccagaaggucaccaucuccugcuccggcuccgccuccaacaucggcaagaacuccgucuccugguaccagcaguuccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17685 - RNA, 333 nt, Artificial Sequence
  derived and/or modified sequence opt2 from anti-HIV_119-075465_VR-Chain
caguccguccucacccagccccccuccgucuccgccgcccccggccagaaggucgucaucuccugcuccggcuccuccuccaucaucggcaacaacuacgucuccugguaccagcagcuccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggcgccggcaccaaggucaccguccuc

SEQ ID NO: 17686 - RNA, 330 nt, Artificial Sequence
  derived and/or modified sequence opt2 from anti-HIV_119-074822_VR-Chain
uccguccucacccagccccccuccgucuccgccgcccccggccagaacaucaccaucuccugcuccggcggcuccuccaacaucgccaagaacuacaucuccugguaccagcaccuccccggcaccgcccccaagaucgucaucuacgacaacgacaagcgcccccucggcauccccgaccgcuucuccgccuccaaguccggcaccuccgccacccucggcaucaccggccuccagaccggcgacgaggccgacuacuacugcgccgucuggggcguccgccgcggcgucggcgccgucuucggcgccggcaccaaggucaucguccuc

SEQ ID NO: 17687 - RNA, 333 nt, Artificial Sequence
  derived and/or modified sequence opt2 from anti-HIV_119-074629_VR-Chain
caguccguccucacccagccccccuccgaguccgccgcccccggccagaaggucaccaucuccugcuccggcggcaccuccaacaucggcaacaacuacgucuccugguaccgccgccuccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggcgccggcaccaaggucaccguccuc

SEQ ID NO: 17688 - RNA, 324 nt, Artificial Sequence
  derived and/or modified sequence opt2 from anti-HIV_119-074500_VR-Chain
caguccguccucacccagccccccuccgucuccgccgcccccggccagaaggucaccauguccugcuccggcuccuccuccaacaucggcaacaacuacgucuccugguaccaguaccuccccggcaccgcccccaagcuccucaucuacgagaacgaccgccgccccuccggcauccccgaccgcuucuccgccuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17689 - RNA, 333 nt, Artificial Sequence
  derived and/or modified sequence opt2 from anti-HIV_119-073911_VR-Chain
caguccguccucacccagccccccuccgucuccgccgcccccggccagcgcgucaccaucuccugcuccggcuccuccuccaacaucgagaacaacuacgucuccugguaccagcaccuccccggcaccgcccccaagcuccucgucuacgacgacaacaagcgccccuccggcaucccccaccgcuucuccgccuccaaguccggcaccuccgccacccucgccaucaccggccuccagaccggcgacgaggccgacuacuacugcacccucuggggcguccgcaagggcgucggcgccgucuucggcaccggcaccaaggucaccguccuc

SEQ ID NO: 17690 - RNA, 324 nt, Artificial Sequence
  derived and/or modified sequence opt2 from anti-HIV_119-072765_VR-Chain
caguccguccucacccagccccccuccgucuccgccgcccccggccagaaggucaccaucuccugcuccggcaacuccuccaacaucggcaacaacuucgucuccugguaccagcagguccccggcaccgcccccaagcuccucgucuacgagaccuaccgccgccccuccggcacccccgaccgcuucuccggcuccaaguccggcaccuccgccacccucgccaucuccggccuccagaccggcgacgaggccgacuacuacugcggcaccugggacggcuccggcggcgucuucggcaccggcaccaaggucaccguccuc

SEQ ID NO: 17691 - RNA, 333 nt, Artificial Sequence
  derived and/or modified sequence opt2 from anti-HIV_119-072313_VR-Chain
caguucguccucacccagccccccuccgucuccgccgcccccggccagaaggucaccaucuccugcuccgccuccuccuccaucaucggcaagaacuacgucuccugguaccagcaguuccccggcaccgcccccaagcuccucaucuacgaggacaacaagcgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17692 - RNA, 333 nt, Artificial Sequence
  derived and/or modified sequence opt2 from anti-HIV_119-072280_VR-Chain
caguccguccucacccagccccccuccgucuccgccgcccccggccagaaggucuccaucuccugcuccggcuccgacuccaaccucggcgacaacuacgucuccugguaccagcaguuccccggcaccgcccccaagcuccucauccacgacaacaacaagcgccccuccggcacccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17693 - RNA, 333 nt, Artificial Sequence
  derived and/or modified sequence opt2 from anti-HIV_119-071693_VR-Chain
caguccguccucacccagccccccuccgucuccgccgcccccggccagaaggucgucaucuccugcuccggcuccuccuccaucaucgagaagaacuccaucuccugguaccagcagggccccggcgccgcccccaagcuccucaucuacgagaacgacaagcgccccuccggcauccccgaccgcuucuccggcuccaaguccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17694 - RNA, 321 nt, Artificial Sequence
  derived and/or modified sequence opt2 from anti-HIV_119-071353_VR-Chain
caguccguccucacccagccccccuccgccuccgccgcccccggccagaaggucaccaucuccugcuccggcuccaacuccaacaucggcaacaacuucgucuccugguaccagcucuuccccggcaccgcccccaagcuccucaucuucgagaacaacaagcgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17695 - RNA, 324 nt, Artificial Sequence
  derived and/or modified sequence opt2 from anti-HIV_119-069711_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaaccgccccuccggcguccccgaccgcuucuccggcuccaaguccggcaccuccgccacccucgccaucaccggccuccagaccggcgacgaggccgacuacuacugcgagaccugggacgacuccggcggcgucuucggcaccggcaccaaggucaccguccuc

SEQ ID NO: 17696 - RNA, 333 nt, Artificial Sequence
  derived and/or modified sequence opt2 from anti-HIV_119-069061_VR-Chain
caguccguccucacccagccccccuccgucuccgccgcccccggccagaaggucaccaucuccugcuccggcuccuccuccaacaucggcuccaacuacgucuccugguaccagcagcuccccggcaccgcccccaagcuccucgucuacgacaacaacgagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17697 - RNA, 324 nt, Artificial Sequence
  derived and/or modified sequence opt2 from anti-HIV_119-068202_VR-Chain
caguccguccucacccaggagcccuccgucuccggcgcccccggccagcgcgucaccaucuccugcaccggcuccaacuccaacaucggcggccacgacguccacugguaccagcagcuccccggcaccgcccccaagcuccucaucuacgacaacgacaagcgccccuccggcauccccgaccgcuucuccggcuccaaguccgacaccuccgccucccucggcaucaccggccuccagaccggcgacgaggccgacuacuacugcgagaccugggacggcuccggcggcgucuucggcaccggcaccaaggucaccguccuc

SEQ ID NO: 17698 - RNA, 324 nt, Artificial Sequence
  derived and/or modified sequence opt2 from anti-HIV_119-068063_VR-Chain
caguccgcccucacccagccccccuccgccuccggcucccucggccaguccgucaccaucuccugcaccggcacccgcuccgacgucggcaacuacuacgucuccugguaccagcagcuccccggcaccgcccccaagcuccucaucuccgagaacaaccgccgccccuccggcacccccgaccgcuucuccggcuccaaguccggcaccuccgccacccucgccaucuccggccuccagaccggcgacgaggccgacuacuacugcggcaccugggacggcuccggcggcgucuucggcaccggcaccaaggucaccguccuc

SEQ ID NO: 17699 - RNA, 333 nt, Artificial Sequence
  derived and/or modified sequence opt2 from anti-HIV_119-067980_VR-Chain
caguccguccucacccagccccccuccgucuccgccgcccccggccagaaggucaccaucuccugcuccggcaacuccuccaacaucggcaacaacuucgucuccugguaccagcagguccccggcaccgcccccaagcuccucgucuacgagaccuaccgccgccccuccggcauccccgaccgcuucuccggcuccaaguccggcaccuccgccacccucgccaucaccggccuccagaccggcgacgaggccgacuaccacugcgccaucuggggcguccgcaagggcgucggcgccgucuucggcaccggcaccaaggucaccgucguc

SEQ ID NO: 17700 - RNA, 324 nt, Artificial Sequence
  derived and/or modified sequence opt2 from anti-HIV_119-067866_VR-Chain
caguccguccucacccagccccccuccgucuccgccgcccccggccagaaggucaccaucuccugcuccggcuccaccuccaccaucggcaacaacuacgucuccugguaccagcaccuccccggcaccgcccccaagcuccucaucuacgacaacaacaagcgccccgccggcauccccgaccgcuucaccgccuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17701 - RNA, 321 nt, Artificial Sequence
  derived and/or modified sequence opt2 from anti-HIV_119-067756_VR-Chain
caguccguccucacccagccccccuccgucuccgccgcccccggccagaaggucgucaucuccugcuccggcuccaccuccaacaucggcaagaacuucgucuccugguaccagcagcuccccggcaccgcccccaagcuccucaucuacgagaacucccgccgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17702 - RNA, 321 nt, Artificial Sequence
  derived and/or modified sequence opt2 from anti-HIV_119-066859_VR-Chain
caguccguccucacccagccccccuccgucuccgccgcccccggccagaaggucaccaucaccugcuccggcuccgccuccaacaucgagaacaacuacgucuccugguaccagcaguuccccggccccgcccccaagcuccucaucuacgagaacgacaagcgccccuccggcauccccgaccgcuucuccggcuccgccuccggcaccuccgccacccucgccaucaccggccuccagaccggcgacgaggccgacuacuucugcuccaccugguccggcucccucaacuucggcaccggcacccgcgucaccguccuc

SEQ ID NO: 17703 - RNA, 333 nt, Artificial Sequence
  derived and/or modified sequence opt2 from anti-HIV_119-065821_VR-Chain
caguccguccucacccagccccccuccgucuccgccacccccggccagcgcgucaccgucuccugcuccggcuccuccuccaacaucggcaaccacuacgucuccugguaccagcagguccccggcaccgcccccaagcuccucaucuacgacaacuccaaccgccccuccggcauccccgaccgcuucuccggcuccaaguccggcaccuccgccacccucggcaucaccggccuccagaccggcgacgaggccgacuacuacugcaccgucuggggcguccgcaagggcgucggcgccgucuucggcaccggcaccaaggucaccguccuc

SEQ ID NO: 17704 - RNA, 333 nt, Artificial Sequence
  derived and/or modified sequence opt2 from anti-HIV_119-065191_VR-Chain
caguccguccucacccagccccccuccgucuccgccgcccccggccagaaggucaccaucuccugcuccggcaacaacuccaacaucggcaacaacuacgucuccugguaccagcagcuccccggcaccgcccccaagcuccucaucuucgagaaccacaagcgccccuccggcauccccgaccgcuucuccggcuccaaguccggcaccuccgccacccucggcaucaccggccuccaguccggcgacgaggccgacuacuacugcgccaccugggccccccgccucaacuccgcccgcgucuucggcaccggcaccaaggucaccguccuc

SEQ ID NO: 17705 - RNA, 333 nt, Artificial Sequence
  derived and/or modified sequence opt2 from anti-HIV_119-064667_VR-Chain
caguccguccucacccagccccccuccgucuccgccgcccccggccagaaggucaccaucuccugcuccggcuccaacuccuacaucggcaacaaguacgucuccugguaccagcagguccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17706 - RNA, 324 nt, Artificial Sequence
  derived and/or modified sequence opt2 from anti-HIV_119-063791_VR-Chain
caguccguccucacccagccccccuccgucuccgccgcccccggccagaagguccccaucuccugcuccggcaacuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17707 - RNA, 333 nt, Artificial Sequence
  derived and/or modified sequence opt2 from anti-HIV_119-062989_VR-Chain
caguccguccucacccagccccccuccgucuccgccgcccccggccagcgcgucaccaucuccugcuccggcuccuccuccaacaucggcaacaacuucgucuccugguaccagcaguuccccggcaccguccccaagcuccucaucuacgagaacaaccgccgccccuccggcauccccgaccgcuucuccggcuccaaguccggcaccuccgccacccucgccaucaccggccuccagaccggcgacgaggccgacuacuacugcgccgucuggggcguccgccgcggcgucggcgccgucuucggcgccggcaccaaggucaucguccuc

SEQ ID NO: 17708 - RNA, 321 nt, Artificial Sequence
  derived and/or modified sequence opt2 from anti-HIV_119-062286_VR-Chain
caguccguccucacccagccccccuccgucuccgccgcccccggccagaaggucaccaucuccugcuccggcuccgccuccaacaucggcaagaacuucgucuccugguaccagcagcuccccggcaccgcccccaagcuccucaucuccgagaacaaccgccgccccuccggcacccccgaccgcuucuccggcuccaaguccggcgccuccgccacccucgucaucuccggccuccagaccggcgacgaggccgacuacuacugcgccaccugguccggcucccucuccaucggcaccggcaccaaggucaccguccuc

SEQ ID NO: 17709 - RNA, 321 nt, Artificial Sequence
  derived and/or modified sequence opt2 from anti-HIV_119-061416_VR-Chain
caguccguccucacccagccccccuccgucuccgccgcccccggccagaaggucgucaucuccugcuccggcuccuccuccaucuucgagaagaacuccaucuccugguaccagcagggccccggcgccgcccccaagcuccucaucuacgagaacgacaagcgccgcuccggcauccccgaccgcuucuccggcuccaaguccgccaccuccaccacccucgccaucgucggccuccagaccggcgacgaggccgacuacuucugcuccaccugguccggcucccucaacuucggcaccggcacccgcgucaccguccuc

SEQ ID NO: 17710 - RNA, 321 nt, Artificial Sequence
  derived and/or modified sequence opt2 from anti-HIV_119-061344_VR-Chain
caguccguccucacccagccccccuccgucuccgccgcccccggccagaaggucaccaucuccugcuccggcuccuccuccgucuucggcaagaacuacgucuccugguaccagcaccuccccggcaccgcccccaagcuccucaucuacgagaacaacaagcgccccuccggcauccccgaccgcuucuccggcgccaaguccggcaccgccgccacccucgccaucaccggccuccagaccggcgacgaggccgacuacuacugcgccaccugguccggcucccucaacuucggcaccggcaccaaggucaccguccuc

SEQ ID NO: 17711 - RNA, 324 nt, Artificial Sequence
  derived and/or modified sequence opt2 from anti-HIV_119-060240_VR-Chain
caguccguccucacccagccccccuccgaguacggcgcccccggccacaacgucaccgucuccugcuccggcaccaccuccaacaucgagaacaacuucgucuccugguaccucaucguccccggcaccgcccccaagcuccucaucuucgacaacgacaagcgccccuccggcauccccgaccgcuucuccggcuccaaguccggcaccuccgccacccucgccaucaccggccuccagaccggcgacgaggccgacuacuacugcgccaccugggacggccgcgucuccgucaucggcaccggcaccaaggucaccguccuc

SEQ ID NO: 17712 - RNA, 333 nt, Artificial Sequence
  derived and/or modified sequence opt2 from anti-HIV_119-060184_VR-Chain
caguccguccucacccagccccccuccgucuccggcgcccccggccagcgcgucaccaucuccugcuccggcuccuccuccaacaucggcuccaacaccgucaacugguaccagcagcuccccggcaccgcccccaagcuccucaucuacgacaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17713 - RNA, 321 nt, Artificial Sequence
  derived and/or modified sequence opt2 from anti-HIV_119-058035_VR-Chain
caguccguccucacccagccccccuccgucuccgccgcccccggccagaaggucaccaucuccugcuccggcuccgccuccaacaucggcaagaacuucgucuccugguaccagcagcuccccggcaccgcccccaagcuccucaucuacgagaacaaccgccgccccuccggcacccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17714 - RNA, 321 nt, Artificial Sequence
  derived and/or modified sequence opt2 from anti-HIV_119-057858_VR-Chain
caguccguccucacccagccccccuccgucuccgccgcccccggccagaacgucaacaucuccugcuccggcggcuccuccaacaucggcuccaacuacgucuccugguaccagcaguuccccggcaccgcccccaagcuccucaucuacgagaacaacaagcgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17715 - RNA, 324 nt, Artificial Sequence
  derived and/or modified sequence opt2 from anti-HIV_119-057473_VR-Chain
caguccguccucacccagccccccuccgucuccgccgcccccggccagaaggucaccaucuccugcuccggcuccuccuccaacaucggcaacaacuacgucuccugguaccagcaccuccccggcaccgcccccaagcuccucaucuacgacaccuacucccgccccuccggcauccccgaccgcuucuccggcuccaaguccggcaccuccgccacccucgccaucaccggccuccagaccggcgacgaggccgacuacuacugcggcaccugggacggcuccggcggcgucuucggcaccggcaccaaggucaccguccuc

SEQ ID NO: 17716 - RNA, 321 nt, Artificial Sequence
  derived and/or modified sequence opt2 from anti-HIV_119-057090_VR-Chain
caguccguccucacccagccccccuccgucuccgccgcccccggccagaccgucaccaucuccugcuccggcuccaccuccaacaucggcaagaacgacgucuccugguaccagcagcuccccggcaccgcccccaagcuccucaucuccgagaacaaccgccgccccuccggcacccccgaccgcuucuccgccuccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17717 - RNA, 333 nt, Artificial Sequence
  derived and/or modified sequence opt2 from anti-HIV_119-055754_VR-Chain
caguccguccucacccagccccccuccgucuccgccgcccccggccagaaggucaccaucuccugcuccggcaacuccuccuccaucggcaacaacuucgucuccugguaccagcagcuccccggcaccgcccccaagcuccucgucuacgagaacuaccgccgccccuccggcauccccgaccgcuucuccggcuccaaguccggcaccuccgccacccucgccaucgacggccuccagaccugggacgaggccgacuaccacugcgccaucuggggcguccgcaagggcgucggcgccgucuucggcaccggcaccaaggucaccgucguc

SEQ ID NO: 17718 - RNA, 324 nt, Artificial Sequence
  derived and/or modified sequence opt2 from anti-HIV_119-054899_VR-Chain
caguccguccucacccagccccccuccgucuccgccgcccccggccagaaggucaccaucuccugcuccggcuccaacuccuacaucggcaacaaguacgucuccugguaccagcaguuccccggcaccgcccccaagcuccucauccacgagaacaaccgccgccccuccggcacccccgaccgcuucuccggcuccaaguccggcaccuccgccacccucgccaucuccggccuccagaccggcgacgaggccgacuacuacugcgagaccugggacggcuccggcggcgucuucggcaccggcaccaaggucaccguccuc

SEQ ID NO: 17719 - RNA, 324 nt, Artificial Sequence
  derived and/or modified sequence opt2 from anti-HIV_119-054501_VR-Chain
caguccguccucacccagccccccuccgucuccgccgcccccggccagaaggucaccaucuccugcuccggcaccuccuccaacaucggcaacaacuacgucuccugguaccagcaccuccccggcaccgcccccaagcuccucaucuucgagaccaacaagcgccccuccggcauccccgaccgcuucuccgccuccaaguccggcaccuccgccacccucgccaucaccggccuccagaccggcgacgaggccgacuacuacugcgagaccugggacggcuccggcggcgucuucggccccggcacccgcgucaccguccuc

SEQ ID NO: 17720 - RNA, 324 nt, Artificial Sequence
  derived and/or modified sequence opt2 from anti-HIV_119-051867_VR-Chain
caguccguccucacccagccccccuccgucuccgccgcccccggccagaaggucaccaucuccugcuccggcaacuccuccaacaucggcaacaacuucaucuccugguaccagcagcuccccggcaccgcccccaagcuccucaucuacgagaacgaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17721 - RNA, 324 nt, Artificial Sequence
  derived and/or modified sequence opt2 from anti-HIV_119-051814_VR-Chain
caguccguccucacccagccccccuccgucuccgccgcccccggccagaaggucaccaucuccugcuccggcuccaacuccaacaucggcaacaaggacgucuccugguaccagcagauccccgccaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcgccaccugggacggccgcgucuccgucaucggcaccggcaccaacgucaucguccuc

SEQ ID NO: 17722 - RNA, 321 nt, Artificial Sequence
  derived and/or modified sequence opt2 from anti-HIV_119-051567_VR-Chain
caguccguccucacccagccccccuccgucuccgccgcccccggccagaaggucaccaucuacugcuccggcucccgcuccaacaucggccgcaacuacgccuccugguaccagcagcuccccggcaccgcccccaagcuccucaucuucgacaacaaccgccgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17723 - RNA, 324 nt, Artificial Sequence
  derived and/or modified sequence opt2 from anti-HIV_119-051483_VR-Chain
caguccguccucacccagccccccuccgucuccgccgcccccggccagaagcucaccaucuccugcuccggcaccuccuccaacaucggcaacaacuacgucuccugguaccagcaccuccccggcaccgcccccaagcuccucaucuacgagaacaaccgccgccccuccggcauccccgagcgcuucuccgccuccaaguccggcaccuccgccacccucggcaucaccggccuccagaccggcgacgaggccgacuacuacugcgagaccugggacgacuccggcggcgucuucggcaccggcaccaaggucaccguccuc

SEQ ID NO: 17724 - RNA, 333 nt, Artificial Sequence
  derived and/or modified sequence opt2 from anti-HIV_119-050913_VR-Chain
caguccguccucacccagccccccuccgucuccgccgcccccggccagaaggucaccaucuccugcuccggcggcaccuccaacaucggcaacaacuacgucuccugguaccagcagcuccccggcaccgccccccgccuccucaucuacgagaccaacaagcgccccuccggcauccccgaccgcuucuucggcuccaaguccggcaccuccgccacccucgccaucuccggccuccagaccggcgacgaggccgacuacuacugcaccgucuggggcguccgcaagggcgucggcgccgucuucggcaccggcaccaaggucaccguccuc

SEQ ID NO: 17725 - RNA, 333 nt, Artificial Sequence
  derived and/or modified sequence opt2 from anti-HIV_119-050187_VR-Chain
caguccguccucacccagccccccuccgucuccgccgcccccggccagaaggucaccaucuccugcuccggcuccuccuccaacaucggcaagaacuccgucuccugguaccagcaguuccccggcaccgcccccaagcuccucaucuacgagaacaacaagcgccccuccggcauccccgaccgcuucuccgacucccaguccggcaccuccgccacccucgccaucaccggccuccagaccggcgacgaggccgacuacuccugcgccaccugggccgccucccucaacuccgcccgcgucuucggcaccggcacccgcgucaccguccuc

SEQ ID NO: 17726 - RNA, 324 nt, Artificial Sequence
  derived and/or modified sequence opt2 from anti-HIV_119-049069_VR-Chain
caguccguccucacccagccccccuccgucuccgccgcccccggccagaaggucaccaucuccugcuccggcuccaccuccaacaucggcaaguccgacgucuucugguaccagcagcuccccggcaccgcccccaagcuccucaucuccgagaccucccgccgccccuccggcacccccgaccgcuucuccggcuccaaguccggcaccuccgccacccucaccaucaccggccuccagaccggcgacgaggccgacuacuacugcgaggccugggacggcuccggcggcgucuucggcaccggcaccaaggucaccguccuc

SEQ ID NO: 17727 - RNA, 333 nt, Artificial Sequence
  derived and/or modified sequence opt2 from anti-HIV_119-048517_VR-Chain
caguccguccucacccagccccccuccgucuccgccgcccccggccagaaggucaccaucuccugcuccggcuccaaguucaacaucggcaacaaggacgucuccugguaccagcacucccccggcaccgcccccaagcuccucaucuacgagaacaacaagcgccccuccggcauccccgaccgcuucuccggcuccaaguccggcaccuccgccacccucggcaucuccggccuccagaccggcgacgaggccgacuacugcugcgccgucuggggcguccgccgcggcgccggcgccgucuucggcgccggcaccaaggucaccguccuc

SEQ ID NO: 17728 - RNA, 333 nt, Artificial Sequence
  derived and/or modified sequence opt2 from anti-HIV_119-048470_VR-Chain
caguccguccucacccagccccccuccgucuccgccgcccccggccagaaggucaccaucuccugcuccggcuccaccuccaacaucggcaagaaccucgucuccugguaccagcaguuccccggcaccgcccccaagcuccucaucuacgagaacaaccgccgccccuccggcauccccgaccgcuucuccggcuccaaguccggcaccuccgccacccucgucaucaccggccuccagaccggcgacgaggccgacuucuacugcggcaccuggggcggcucccuccgcgccggcggcgucaucggcaccggcacccgcgucaccguccuc

SEQ ID NO: 17729 - RNA, 282 nt, Artificial Sequence
  derived and/or modified sequence opt2 from anti-HIV_119-048303_VR-Chain
uccguccucacccagccccccuccgucuccgccgcccccggccagaacaucaccaucuccugcuccggcuccaucuccaacaucgccuccaacuucaucuccugguaccagcagcuccccggcaccgcccccaagaucaucaucuacgacaacgaccagcgcccccucggcauccccgcccgcuucuccggcuccaaguccggcgccuccgccacccucgucaucaccggccuccagaccggcgacgaggccgacuacuacugcggcaccugggacggcucc

SEQ ID NO: 17730 - RNA, 333 nt, Artificial Sequence
  derived and/or modified sequence opt2 from anti-HIV_119-048021_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaagcgccccuccggcauccccgaccgcuucuccggcuccaaguccggcaccuccgccacccucgucaucaccggccuccagaccggcgacgaggccgacuucuacugcggcaccugggacggcucccucuccggcggcggcgucaucggcaccggcacccgcgucaccguccuc

SEQ ID NO: 17731 - RNA, 324 nt, Artificial Sequence
  derived and/or modified sequence opt2 from anti-HIV_119-047928_VR-Chain
caguccguccucacccagccccccuccgucuccgccgcccccggccagaaggucaccaucuccugcuccggcuccaacuccaacaucggcaacaacugcgucuccugguaccagcagguccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacuacugcggcaccugggacggcuccggcggcgucuucggcaccgccaccaaggucaccguccuc

SEQ ID NO: 17732 - RNA, 324 nt, Artificial Sequence
  derived and/or modified sequence opt2 from anti-HIV_119-047384_VR-Chain
caguccguccucacccagccccccuccgucuccgccgcccccggccagaaggucaccaucuccugcuccggcuccaacuccaacaucggcaacaaggacgucuccugguaccgccaggucccccccaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcgccaccugggacggccgcgucuccgucuucggcaccggcaccaaggucgccguccuc

SEQ ID NO: 17733 - RNA, 333 nt, Artificial Sequence
  derived and/or modified sequence opt2 from anti-HIV_119-047145_VR-Chain
caguccguccucacccagccccccuccgucuccgccgcccccggccagaccgucaacaucuccugcuccggcuccaacuccaacaucggcuccaaguacgucuccugguaccagcacuuccccggcaccgcccccaagcuccucaucuacgagaacaacaagcgcuccuccggcauccccgaccgcuucuccggcuccaaguccgccaccuccgccacccucgccaucaccggccuccagaccggcgacgaggccgacuacuacugcgccaccugggcccccucccucaacuccgcccgcgucuucggcaccggcaccaaggucaccguccuc

SEQ ID NO: 17734 - RNA, 333 nt, Artificial Sequence
  derived and/or modified sequence opt2 from anti-HIV_119-046752_VR-Chain
caguccguccucacccagccccccuccgucuccgccgcccccggccagaaggucaccaucuccugcuccggcaacuccuccuccaucggcaacaacuucgucuccugguaccagcagcuccccggcaccgcccccaagcuccucgucuacgagaacuaccgccgccccuccggcaucuccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17735 - RNA, 324 nt, Artificial Sequence
  derived and/or modified sequence opt2 from anti-HIV_119-046660_VR-Chain
caguccguccucacccagccccccuccgucuccgccgcccccggccagaaggucaccaucuccugcuccggcuccuccuccaacaucggcaaccacuacgucuccugguaccagcagcuccccggcaccgcccccaagcuccucaucuacgacaacaacaagcgccccuccggcauccccgaccgcuucuccgccuccaaguccggcaccuccgccacccucggcaucaccggccuccagaccggcgacgaggccgacuacuacugcgccaccugggacggccgcgucuccgucaucggcaccggcaccaaggucaccgucguc

SEQ ID NO: 17736 - RNA, 333 nt, Artificial Sequence
  derived and/or modified sequence opt2 from anti-HIV_119-046202_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucgucuacgagaacuaccgccgccccuccggcauccccgaccgcuucuccggcuccaaguccggcaccuccgccacccucgccaucaccggccuccagaccggcgacgaggccgacuaccacugcgccaucuggggcguccgcaagggcgucggcgccgucuucggcaccggcaccaaggucaccgucguc

SEQ ID NO: 17737 - RNA, 333 nt, Artificial Sequence
  derived and/or modified sequence opt2 from anti-HIV_119-045790_VR-Chain
caguccguccucacccagccccccuccgucuccgccgcccccggccagaaggucaccaucuccugcuccggcuccuccuccaacaucggcaacaacuacgucuccugguaccaguaccuccccggcaccgcccccaagcuccucuucuacgaggacaaccgccgccccuccggcacccccgaccgcuucuccggcuccaaguccggcaccuccgccacccucgccaucuccggccuccagaccggcgacgaggccgacuacuacugcaccaucuggggcguccgcaagggcgucggcgccgucuucggcaccggcaccaaggucaccguccuc

SEQ ID NO: 17738 - RNA, 333 nt, Artificial Sequence
  derived and/or modified sequence opt2 from anti-HIV_119-044670_VR-Chain
caguccguccucacccagccccccuccgucuccggcgcccccggcgagcgcgucaccaucuccugcaccggcaacaccuccaacaucggcaccuacgacguccagugguaccagcaccuccccggcaccgccccccgccuccucaucuaccacaacgucaaccuccccuccggcguccccgaccgcuucuccgccuccaaguccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17739 - RNA, 321 nt, Artificial Sequence
  derived and/or modified sequence opt2 from anti-HIV_119-044140_VR-Chain
caguccguccucacccagccccccuccgucuccgccgcccccggccagaaggucaccaucuccugcuccggcggcaccuccaacaucggcaaccacuucgucuccugguaccgccaccuccccggcaccgcccccaagcuccucaucuacgagaacaacaaccgccccuccggcauccccgaccgcuucuccggcgccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17740 - RNA, 333 nt, Artificial Sequence
  derived and/or modified sequence opt2 from anti-HIV_119-042776_VR-Chain
caguccguccucacccagccccccuccgucuccgccgcccccggccagaaggucaccaucuccugcuccggcuccuccuccaacaucggcaacaacuacgucuccugguaccagcaccuccccggcaccgcccccaagcuccucaucuacgaguccgcccgccgccccuccggcacccccgaccgcuucuccggcuccaaguccggcaccuccgccacccucgccaucaccggccuccagaccggcgacgaggccgacuacuacugcacccucuggggcguccgcaagggcgucggcgccgucuucggcaccggcacccgcgucaccguccuc

SEQ ID NO: 17741 - RNA, 333 nt, Artificial Sequence
  derived and/or modified sequence opt2 from anti-HIV_119-042581_VR-Chain
caguccguccucacccagccccccuccgucuccgccgcccccggccagaaggucaccaucuccugcuccggcuccuccuccaacaucggcaacaacuucgucuccugguaccagcagcuccccggcaccgcccccaagcuccucaucuucgagacccaccgccgccccuccggcauccccgaccgcuucuccggcuccaaguccggcaccuccgccacccucgccaucaccggccuccaguccggcgacgaggccgacuacuacugcgccgucuggggcguccgccagggcgccggcgccgucuucggcaccggcaccaaggucaccguccuc

SEQ ID NO: 17742 - RNA, 333 nt, Artificial Sequence
  derived and/or modified sequence opt2 from anti-HIV_119-040905_VR-Chain
caguccguccucacccagccccccuccgucuccgccgcccccggccagaaggucaccaucuccugcuccggcaacuccuccaacaucggcgacaacuucgucuccugguaccagcagcuccccggcaucgcccccaagcuccucgucuacgagaccaacaagcgccccuccggcauccccgaccgcuucgccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17743 - RNA, 321 nt, Artificial Sequence
  derived and/or modified sequence opt2 from anti-HIV_119-040322_VR-Chain
caguccguccucacccagccccccuccgucuccgccgcccccggccagaaggucgucaucuccugcuccggcuccuccuccaucaucgagaagaacuccaucuccugguaccagcagggccccggcgccgcccccaagcuccucaucuacgagaacgacaagcgccccuccggcauccccgaccgcuucuccggcuccaaguccggcaccaccggcacccucgccaucaccggccuccagaccggcgacgaggccgacuacuucugcgccaccugguccggccgccucaacaucggcaccggcaccaaggucaccguccuc

SEQ ID NO: 17744 - RNA, 324 nt, Artificial Sequence
  derived and/or modified sequence opt2 from anti-HIV_119-039892_VR-Chain
caguccguccucacccagccccccuccgucuccgccgcccccggccagaaggucaccaucuccugcuccggcuccaacgccaacaucggcaacaaggacgucuccugguaccagcagcuccccgccaccgcccccaagcuccucaucuacgaguccaacaagcgccccuccggcauccccgaccgcuucuccggcuccaaguccggcaccuccgccacccucgccaucaccggccuccagaccggcgacgaggccgacuacuacugcgccaccugggacggccgcgucuccggcaucggcaccggcaccaaggucaccguccuc

SEQ ID NO: 17745 - RNA, 324 nt, Artificial Sequence
  derived and/or modified sequence opt2 from anti-HIV_119-039764_VR-Chain
caguccguccucacccagccccccuccgucuccgccgcccccggccagaaggucaccaucuccugcuccggcuccgccuccaacaucggcaagaacuucgucuccugguaccagcagguccccggcaccgcccccaagcuccucaucuacgagaacaaccgccgccccuccggcacccccgaccgcuucuccggcuccaaguccggcaccuccggcacccucgccaucuccggccuccagaccggcgacgaggccgacuacuacugcgagaccugggacggcuccggcggcgucuucggcaccggcaccaaggucaccguccuc

SEQ ID NO: 17746 - RNA, 333 nt, Artificial Sequence
  derived and/or modified sequence opt2 from anti-HIV_119-039188_VR-Chain
caguccguccucacccagccccccucccucuccggcgcccccggccagaccgucaccaucuccugcuccggcuccuccuccaacaucggcaacaacuacgucuccugguaccagcagcuccccggcaccgcccccaagcuccucaucuacgacuccaaccgccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggcgccggcaccaaggucaccguccuc

SEQ ID NO: 17747 - RNA, 321 nt, Artificial Sequence
  derived and/or modified sequence opt2 from anti-HIV_119-039058_VR-Chain
caguccguccucacccagccccccuccgucuccggcgcccccggccagcgcgucaccaucuccugcaccggcuccuccuccaacaucggcaacaacuacgucuccugguaccgccgccuccccggcaccgcccccaagcuccucaucuacgagaacaacaagcgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17748 - RNA, 321 nt, Artificial Sequence
  derived and/or modified sequence opt2 from anti-HIV_119-038837_VR-Chain
caguccguccucacccagccccccuccgucuccgccgcccccggccagaaggucaccaucuccugcuccggcggcaccuccaacaucggcaacaacuucgucuccugguaccagcaccuccccggcaccgcccccaagcuccucaucuucgagaacaacaagcgccccuccggcguccccgaccgcuucuccggcgccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17749 - RNA, 321 nt, Artificial Sequence
  derived and/or modified sequence opt2 from anti-HIV_119-038396_VR-Chain
caguccguccucacccagccccccuccgucuccgccacccccggccagaaggucaccaucuccugcuccggcuccaacuccaacaucggcaacaaguacgucuccugguaccagcucuuccccggcaccgcccccaagcuccucaucuccgagaacaaccgccgccccuccggcacccccgaccgcuucuccggcuccaaguccggcaccuccgccacccucgccaucaccggccuccagaccggcgacgaggccgacuacuacugcgccaccugguccggcucccucaacaucggcaccggcaccaaggucaccguccuc

SEQ ID NO: 17750 - RNA, 321 nt, Artificial Sequence
  derived and/or modified sequence opt2 from anti-HIV_119-036918_VR-Chain
caguccguccucacccagccccccuccgucuccgccgcccccggccagaaggucaccaucuccugcuccggcgccaccuccaacaucugggaccacuacgucuccugguaccuccagguccccggcaccgccccccgccuccucaucuacgacaacgacaagcgccccuccggcauccccgaccgcuucuccggcuccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17751 - RNA, 324 nt, Artificial Sequence
  derived and/or modified sequence opt2 from anti-HIV_119-036592_VR-Chain
caguccguccucacccagccccccuccgucuccgccgcccccggccagaaggucaccaucuccugcuccggcuccaacuccaacaccggcaacaaggacgucuccugguaccagcagguccccgccaccgcccccaagcuccucaucuacgaguccaacaagcgccccuccggcauccccgaccgcuucuccggcuccaaguccggcaccuccgccacccucgccaucaccggccuccagaccggcgacgaggccgacuacuacugcgccaucugggacggccgcgucuccgucaucggcaccggcaccaaggucaccguccuc

SEQ ID NO: 17752 - RNA, 324 nt, Artificial Sequence
  derived and/or modified sequence opt2 from anti-HIV_119-036310_VR-Chain
caguccguccucacccagccccccuccgucuccgccgcccccggccagaaggucaccaucuccugcuccggcuccaccuccaacaucggccagaacuacgucuccugguaccagcagcuccccggcaccgcccccaagcuccucaucuacgagaacaaccgccgccccuccggcucccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17753 - RNA, 333 nt, Artificial Sequence
  derived and/or modified sequence opt2 from anti-HIV_119-035618_VR-Chain
caguccguccucacccagccccccuccgucuccgccgcccccggccagaaggucaccaucuccugcuccggcuccuccuucaccaucggcaacaaccacgucuccugguaccagcagcuccccggcaccgcccccaagcuccucaucuucgagucccacaagcgccccuccggcguccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17754 - RNA, 321 nt, Artificial Sequence
  derived and/or modified sequence opt2 from anti-HIV_119-035569_VR-Chain
caguccguccucacccagccccccuccgucuccggcgcccccggccagaccgucaccaucuccugcaccggcuccuccuccaacaucggcggcuacgacguccacugguaccagcagcuccccggcaccgcccccaagcuccucaucuacgagaacaaccgccgccccuccggcacccccgaccgcuucuccggcgccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17755 - RNA, 324 nt, Artificial Sequence
  derived and/or modified sequence opt2 from anti-HIV_119-035466_VR-Chain
caguccguccucacccagccccccuccgucuccgccgccgccggccagaacgucaacaucuccugcuccggcaagaaguccaacaucggcaacaacuacgucuccugguaccagcaguuccccggcaccgcccccaagcuccucaucuacggcaacaccaaccgccccuccggcauccccgaccgcuucuccggcuccaaguccggcaccuccgccacccucgccaucaccggccuccagaccggcgacgacgccgacuacuacugcgagaccugggacggcuccggcggcgucuucggcaccggcaccaaggucaccguccuc

SEQ ID NO: 17756 - RNA, 333 nt, Artificial Sequence
  derived and/or modified sequence opt2 from anti-HIV_119-035157_VR-Chain
caguccguccucacccagccccccuccgucuccgccgcccccggccagaaggucaccaucuccugcuccggcuccuccuccaacaucggcaacaacuucgucuccugguaccagcagcgccccggcaccgcccccaagcuccucaucuacgagaccaacaagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17757 - RNA, 333 nt, Artificial Sequence
  derived and/or modified sequence opt2 from anti-HIV_119-035121_VR-Chain
caguccguccucacccagccccccuccgucuccgccgcccccggccagaaggucaccaucuccugcuccggcuccaccuccuacaucggcaacaaguacgucuccugguaccagcaguuccccggcgccgcccccaagcuccucaucuacgagaacaacaagcgccccuccggcauccccgaccgcuucuccgccuccaaguccgccaccuccgccacccucgccaucaccggccuccagaccggcgacgaggccgacuacugcugcgccgucuggggcguccgccgcggcgccggcgccgucuucggcgccggcaccaaggucaccguccuc

SEQ ID NO: 17758 - RNA, 324 nt, Artificial Sequence
  derived and/or modified sequence opt2 from anti-HIV_119-035046_VR-Chain
caguccgcccucacccagcccgccuccgucuccggcucccccggccaguccaucaccaucuccugcaccggcaccuccuccgacgucggcuacgacuacgucuccugguaccgccagguccccgccaccacccccaagcuccucaucuacgagaacaacaagcgccccuccggcauccccgaccgcuucuccggcuccaaguccggcaccuccgccacccucgccaucaccggccuccagaccggcgacgaggccgacuacuacugcgccaccugggacggccgcgucuccgucaucggcaccggcaccaaggucaccgucguc

SEQ ID NO: 17759 - RNA, 324 nt, Artificial Sequence
  derived and/or modified sequence opt2 from anti-HIV_119-034754_VR-Chain
caguccguccucacccagccccccuccgucuccgccgcccccggcgagaaggucaccaucuccugcuccggcuccuccuccaacaucggcaacaacuacgucuccugguaccagcagcuccccggcaccguccccaagcuccucaucuacgacaacaacaagcgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17760 - RNA, 324 nt, Artificial Sequence
  derived and/or modified sequence opt2 from anti-HIV_119-034318_VR-Chain
caguccguccucacccagccccccuccgucuccgccgcccccggccagaagaucaccaucuccugcuccggcuccuccuccaacaucggcaacaacgacgucuccugguaccagcagcuccccggcaccgcccccaagcuccucaucuacgagaacgaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17761 - RNA, 333 nt, Artificial Sequence
  derived and/or modified sequence opt2 from anti-HIV_119-033780_VR-Chain
caguccguccucacccagccccccuccgucuccgccgcccccggccagcgcgucaccaucuccugcuccggcaccuccuccaacaucggcgagaacuacgucuccugguaccagcagauccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccuggggcggcucccuccgcaccggcggcguccucggcaccggcacccgcgucaccguccuc

SEQ ID NO: 17762 - RNA, 333 nt, Artificial Sequence
  derived and/or modified sequence opt2 from anti-HIV_119-033632_VR-Chain
caguccguccucacccagccccccuccgucuccgccgcccccggccagcgcgucaccaucuccugcuccggcggcuccuccaacaucggcuccaacuacgucuccugguaccagcagcuccccggcaccgcccccaagcuccucaucuaccagaacaacaagcgccccuccggcauccccgaccgcuucuccggcuccaaguccggcaccuccgccacccucggcaucaccggccuccagaccggcgacgaggccgacuacuacugcaccgucuggggcguccgcaagggcgucggcgccgucuucggcaccggcaccaaggucaccguccuc

SEQ ID NO: 17763 - RNA, 333 nt, Artificial Sequence
  derived and/or modified sequence opt2 from anti-HIV_119-033183_VR-Chain
caguccguccucacccagccccccuccgucuccgccgcccccggccagauggucaccaucuccugcuccggcggcgccuccaaccucggcaagaacuccgucuccugguaccagcagcuccccggcaccgcccccaagcuccucaucuacgaggacaaccgccgccccuccggcacccccgaccgcuucuccggcucccgcuccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17764 - RNA, 333 nt, Artificial Sequence
  derived and/or modified sequence opt2 from anti-HIV_119-030696_VR-Chain
caguccguccucacccagccccccuccgucuccggcgcccccggccagaucgucacccucuccugcaccggcgccaugaccaacaucggcaacaacgacguccacugguaccagcaccuccccggcaccggccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccugggacggcucccuccgcaccggcggcgucaucggcaccggcacccgcgucaccguccuc

SEQ ID NO: 17765 - RNA, 324 nt, Artificial Sequence
  derived and/or modified sequence opt2 from anti-HIV_119-030059_VR-Chain
caguccguccucacccagccccccuccgucuccgccgcccccggccagaaggucgucaucuccugcuccggcuccuccuccaucaucgagaagaacuccaucuccugguaccagcagggccccggcgccgcccccaagcuccucaucuacgagaacgacaagcgccccuccggcaucuccgaccgcuucuccggcuccaaguccgccaccuccgccacccucgccaucaccggccuccacaccggcgacgaggccgacuacuacugcgagaccugggacggcuccggcggcgucuucggcaccggcaccaaggucaccguccuc

SEQ ID NO: 17766 - RNA, 333 nt, Artificial Sequence
  derived and/or modified sequence opt2 from anti-HIV_119-029589_VR-Chain
caguccguccucacccagccccccuccgucuccgccgcccccggccagaaggucaccaucuccugcuccggcaccuccuccaacaucggcaacaacuucgucuccugguaccagcuccuccccggcaccgccccccgccuccucaucuacgacaacaacaagcgccccuccggcacccccgaccgcuucuccggcuccaaguccggcaccuccgccacccucggcaucaccggccuccagaccggcgacgaggccgacuucuacugcggcaccugggacggcucccuccgcaccggcggcgucaucggcaccggcacccgcgucaccguccuc

SEQ ID NO: 17767 - RNA, 324 nt, Artificial Sequence
  derived and/or modified sequence opt2 from anti-HIV_119-029448_VR-Chain
caguccguccucacccagccccccuccgucuccgccgcccccggccagaaggucaccaucuccugcuccggcaacuccuccaacaucggcaagaacuccgucuccugguaccaccagcuccccggcaccgcccccaagcuccucaucuacgagaacgaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17768 - RNA, 333 nt, Artificial Sequence
  derived and/or modified sequence opt2 from anti-HIV_119-029220_VR-Chain
caguccguccucacccagccccccuccgucuccgccgcccccggccagaaggucaccaucuccugcuccggcuccaccuccaacaucggccagaacuacgucuccugguaccagcagcuccccggcaccgcccccaagcuccucaucuacgagaacgaccgccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggccccggcaccaaggucaccguccuc

SEQ ID NO: 17769 - RNA, 333 nt, Artificial Sequence
  derived and/or modified sequence opt2 from anti-HIV_119-028317_VR-Chain
caguccguccucacccagccccccuccgucuccgccgcccccggccagaaggucaccaucuccugcuccggcuccuccuccaacaucggcaacgacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17770 - RNA, 324 nt, Artificial Sequence
  derived and/or modified sequence opt2 from anti-HIV_119-028165_VR-Chain
caguccguccucacccagccccccuccgucuccgccgcccccggccagaccgucaccaucuccugcuccggcaucaccuccaacaucggcaagaacgacgucuccugguaccagcagcuccccggcaccgcccccaagcuccucaucuccgagaacaaccgccgccccuccggcauccccgaccgcuucuccggcuccaaguccggcaccuccgccacccucgccaucaccggccuccagaccggcgacgaggccgacuacuacugcgccaucugggacggccgcgucuccgucaucggcaccggcaccaaggucaccguccuc

SEQ ID NO: 17771 - RNA, 324 nt, Artificial Sequence
  derived and/or modified sequence opt2 from anti-HIV_119-027147_VR-Chain
caguccguccucacccagccccccuccgucuccgccgcccccggccagaccgucaccaucuccugcuccggcuccaccuccgacaucggcaagaacgacgucuccugguaccagcagcuccccggcaucgcccccaagcuccucaucuccgagaacaaccgccgccccuccggcacccccgaccgcuucuccggcuccaaguccggcaccuccgccacccucgccaucaccggccuccagaccggcgacgaggccgacuacuacugcgagaccugggacggcuccggcgccgucuucggcaccggcaccaaggucaccguccuc

SEQ ID NO: 17772 - RNA, 333 nt, Artificial Sequence
  derived and/or modified sequence opt2 from anti-HIV_119-026743_VR-Chain
caguccguccucacccagccccccuccgucuccgccgcccccggccagaacgucaccaucuccugcuccggcuccuccuccaacaucggcaacaacuucgucuccugguaccagcagcgccccggcaccggccccaagcuccucaucuacgagaccaaccgccgccccuccggcauccccgaccgcuucuccggcuccaaguccggcaccuccgccacccucgccaucaccggccuccagaccggcgacgaggccgacuacuacugcgccaccugggcccccucccucaacuccgcccgcgucuucggcaccggcaccaaggucaccguccuc

SEQ ID NO: 17773 - RNA, 333 nt, Artificial Sequence
  derived and/or modified sequence opt2 from anti-HIV_119-026508_VR-Chain
caguccguccucacccagccccccuccgucuccgccgcccccggccagaaggucaccaucuccugcuccggcuccuccuccaccaucggcaacaacuacaucuccugguaccagguccuccccggcaccgcccccaagcucgucaucuucaagaacaacgagcgccccucccgcguccccgaccgcuucuccggcuccaaguccggcaccuccgccacccucggcaucaccggccuccagcucggcgacgagggcgacuacuacugcggcaccugggagaccucccucuccggcggcggcgucuucggcaccggcaccaaggucaccguccuc

SEQ ID NO: 17774 - RNA, 324 nt, Artificial Sequence
  derived and/or modified sequence opt2 from anti-HIV_119-025683_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccgacucccaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17775 - RNA, 333 nt, Artificial Sequence
  derived and/or modified sequence opt2 from anti-HIV_119-025614_VR-Chain
cagucccuccucacccagccccccuccgucuccgccgcccccggccagaacgucaucaucuccugcuccggcuccuccuccaacaucggcaagaacuacgucgccugguaccagcagguccccggcaccgcccccaagaucgucgucuucgagaccaccaaccgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17776 - RNA, 324 nt, Artificial Sequence
  derived and/or modified sequence opt2 from anti-HIV_119-025548_VR-Chain
caguccauccucacccagccccccuccgucuccgccgcccccggccagaaggucaccaucuccugcuccggcuccuccuccaacaucggcaacaacuacgucuccugguaccagcacguccccggcaccgcccccaagcuccucaucuacgagaacaaccgccgccccuccggcacccccgaccgcuucuccggcuccaaguccggcaccuccgccacccucgccaucaccggccuccaguccggcgacgaggccgacuacuacugcggcaccugggacggcuccggcggcgucuucggcaccggcaccaaggucaccguccuc

SEQ ID NO: 17777 - RNA, 333 nt, Artificial Sequence
  derived and/or modified sequence opt2 from anti-HIV_119-025526_VR-Chain
caguccguccucacccagccccccuccgucuccgccgcccccggccagaaggucaccaucuccugcuccggcuccgccuccaacaucggcaagaacuucgucuccugguaccagcagcuccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17778 - RNA, 324 nt, Artificial Sequence
  derived and/or modified sequence opt2 from anti-HIV_119-023552_VR-Chain
caguccguccucacccagccccccuccgucuccgccgcccccggccagaccgucaccaucuccugcuccggcuccaccuccaacaucggcaagaacgacgucuccugguaccagcagcuccccggcaccgcccccaagcuccucaucuccgagaacaaccgccgccccuccggcacccccgaccgcuucuccgccuccaaguccggcaccuccgccacccucgccaucaccggccuccagaccggcgacgaggccgacuacuacugcgagaccuggcacggcuccggcggcgucuucggcaccggcaccaaggucaccguccuc

SEQ ID NO: 17779 - RNA, 321 nt, Artificial Sequence
  derived and/or modified sequence opt2 from anti-HIV_119-023092_VR-Chain
caguccguccucacccagccccccuccgucuccgccgcccccggccagaaggucaccaucuccugcuccggcuccaccuccgaccucggccagacccgcgucuccugguaccagcagcucccccgcuccgcccccgagcuccucaucuucgagaacaaccgccgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17780 - RNA, 324 nt, Artificial Sequence
  derived and/or modified sequence opt2 from anti-HIV_119-022793_VR-Chain
caguccguccucacccagccccccuccgucuccgccgcccccggccagaaggucaccaucuccugcuccggcggcaccuccaacaucggcaacaacuacgucuccugguaccgccgccuccccggcaccgcccccaagcuccucaucuacgagaacaacaagcgccccuccggcauccccgaccgcuucuccggcgccaaguccggcaccuccgccacccucggcaucaccggccuccagaccggcgacgaggccgacuacuacugcgagaccugggacgacuccggcggcgucuucggcaccggcaccaaggucaccguccuc

SEQ ID NO: 17781 - RNA, 324 nt, Artificial Sequence
  derived and/or modified sequence opt2 from anti-HIV_119-022395_VR-Chain
caguccguccucacccagccccccuccgucuccgccgcccccggccagaccgucaccaucuccugcuccggcuccaccuccaacaucggcaagaacgacgucuccugguaccagcagcuccccggcaccgcccccaagcuccucaucuccgacaacaaccgccgccccuccuggacccccgaccgcuucuccggcuccaaguccggcaccuccgccacccucgccaucaccggccuccagaccggcgacgaggccgacuacuacugcgagaccugggacggcuccggcggcgucuucggccccggcacccgcgucaccguccuc

SEQ ID NO: 17782 - RNA, 333 nt, Artificial Sequence
  derived and/or modified sequence opt2 from anti-HIV_119-022334_VR-Chain
caguccguccucacccagccccccuccgucuccgccgcccccggccagaacgucaacaucuccugcuccggcggcuccuccaacaucggcuccaacuacgucuccugguaccagcaguuccccggcaccgcccccaagcaccucaucuacgagaacaacaagcgccccuccggcauccccgaccgcuucuccgacucccaguccggcaccuccgccacccucggcaucaccggccuccagaccggcgacgaggccgacuacuacugcggcaccugggacggcucccuccgcaccggcggcgucaucggcaccggcacccgcgucaccguccuc

SEQ ID NO: 17783 - RNA, 321 nt, Artificial Sequence
  derived and/or modified sequence opt2 from anti-HIV_119-021866_VR-Chain
caguccguccucacccagccccccuccgucuccgccgcccccggccagcgcgucaccaucuccugcuccggcuccgccuccaacaucggcaagaacuucgucuccugguaccagcagcuccccggcaaggcccccaagcucaucaucuacgaggucaccaagcgccccuccggcguccccgcccgcuucuccggcuccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17784 - RNA, 324 nt, Artificial Sequence
  derived and/or modified sequence opt2 from anti-HIV_119-021278_VR-Chain
caguccguccucacccagccccccuccgucuccgccgcccccggccagaaggucaccaucuccugcuccggcuccgccuccaacaucggcaagaacuucgucuccugguaccagcagcuccccggcaccgcccccaagcuccucaucuacgagaacaaccgccgccccuccggcacccccgaccgcuucuccggcucccgcuccggcaccuccgccacccucggcaucaccggccuccagaccggcgacgaggcccacuacuacugcgagaccugggacgacuccggcggcgucuucggcaccggcaccaaggucaccguccuc

SEQ ID NO: 17785 - RNA, 333 nt, Artificial Sequence
  derived and/or modified sequence opt2 from anti-HIV_119-021183_VR-Chain
caguccguccucacccagccccccuccgucuccgccgcccccggccagaaggucaccaucuccugcuccggcaacuccuccaacaucggcaacaacuucgucuccugguaccagcaguuccccggcaccgcccccaagcuccucgucuucgagacccaccgccgccccuccggcauccccgaccgcuucuccggcuccaaguccggcaccuccgccacccucgccaucaccggccuccagaccggcgacgaggccgacuacuacugcgccgucuggggcguccgccgcggcgucggcgccgucuucggcgccggcaccaaggucaccguccuc

SEQ ID NO: 17786 - RNA, 333 nt, Artificial Sequence
  derived and/or modified sequence opt2 from anti-HIV_119-019376_VR-Chain
caguccguccucacccagccccccuccgucuccgccgcccccggccagaaggucaccaucuccugcuccggcuccuccuccaacaucggcaacaacuacgucuccugguaccagcagguccccggcaccgcccccaagcuccucgucuacgagaccuaccgccgccccuccggcauccccgaccgcuucuccggcuccaaguccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17787 - RNA, 321 nt, Artificial Sequence
  derived and/or modified sequence opt2 from anti-HIV_119-019238_VR-Chain
caguccguccucacccagccccccuccgucuccgccgcccccggccagaaggucaccaucuccugcuccggcaccuccuccaacaucggcaacaaccacgucuccugguaccagcagguccccggcaccgcccccaagcuccucaucuacgagaacaacaagcgccccuccggcauccccgcccgcuucuccgccgccaaguccggcaccuccgccacccucgccaucaccggccuccagaccggcgacgaggccgacuacuucugcgccaccugguccggccgccucaacaucggcaccggcaccaaggucaccguccuc

SEQ ID NO: 17788 - RNA, 333 nt, Artificial Sequence
  derived and/or modified sequence opt2 from anti-HIV_119-018500_VR-Chain
caguccguccucacccagccccccuccgucuccgccgcccccggccagaaggucaacaucuccugcuccggcuccuccuccaacaucggcaacaacuucgucuccugguaccagcagcgccccggcaccgcccccaagcuccucaucuacgagaccaaccgccgccccuccggcauccccgaccgcuucuccggcuccaaguccggcaccuccgccacccucgccaucaccggccuccagaccggcgacgaggccgacuacuacugcgccaccugggccgccucccucaccuccgcccgcgucuucggcaucggcaccaaggucaccguccuc

SEQ ID NO: 17789 - RNA, 324 nt, Artificial Sequence
  derived and/or modified sequence opt2 from anti-HIV_119-018318_VR-Chain
caguccguccucacccagccccccuccgucuccgccgcccccggccagaccgucaucaucuccugcuccggcuccaccuccaacaucggcaagaacgacgucuccugguaccagcagcuccccggcaccgcccccaagcuccucaucuccgagaacaaccgccgccccuccggcacccccgaccgcuucuccggcuccaaguccggcaccuccgccacccucgccaucaccggccuccagaccggcgacgacgccgacuacuacugcgagaccugggacggcuccggcggcgucuucggcaccggcaccaaggucacccucguc

SEQ ID NO: 17790 - RNA, 333 nt, Artificial Sequence
  derived and/or modified sequence opt2 from anti-HIV_119-018218_VR-Chain
caguccguccucacccagccccccuccgucuccgccgcccccggccagaaggucaccaucuccugcuccggcaacuccuccaacaucggcaacaacuucgucuccugguaccagcagcuccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacuggugcgccgucuggggcguccgccgcggcgccggcgccgucuucggcgccggcaccaaggucaccguccuc

SEQ ID NO: 17791 - RNA, 324 nt, Artificial Sequence
  derived and/or modified sequence opt2 from anti-HIV_119-017876_VR-Chain
caguccguccucacccagccccccuccgucuccgccgcccccggccagaaggucaccaucuccugcuccggcuccaccuccaagaucggccagaacuccgucuccugguaccagcagcuccccggcaccgcccccaagcuccucaucuacgagaacgaccgccgccccuccggcacccccgaccgcuucuccgccuccaaguccggcaccuccgccacccucgccaucaccggccuccagaccggcgacgaggccgacuacuacugcgagaccugggacgacuccggcggcgucuucggcaccggcaccaaggucaccguccuc

SEQ ID NO: 17792 - RNA, 324 nt, Artificial Sequence
  derived and/or modified sequence opt2 from anti-HIV_119-017740_VR-Chain
caguccguccucacccagccccccuccgucuccgccgcccccggccagaaggucaccaucuccugcuccggcuccaacuccaacaucggcaacaaggacgucuccugguaccgccagguccccgccaccgcccccaagcuccccaucuacgagaacaagaacgagcccuccggcguccccgaccgcuucuccggcuccaaguccggcaccuccgccacccucgccaucaccggccuccagaccggcgacgaggccgacuacuacugcgccaccugggacggccgcgucuccgucaucggcaccggcaccaaggucaccgucguc

SEQ ID NO: 17793 - RNA, 321 nt, Artificial Sequence
  derived and/or modified sequence opt2 from anti-HIV_119-017128_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccgaccgcuucuccggcgccaaguccggcaccuccgccacccucgccaucaccggccuccagaccggcgacgaggccgacuacuucugcuccaccugguccggcucccucaacuucggcaccggcacccgcgucaccguccuc

SEQ ID NO: 17794 - RNA, 324 nt, Artificial Sequence
  derived and/or modified sequence opt2 from anti-HIV_119-017044_VR-Chain
caguccguccucacccagccccccuccgucuccgccgcccccggccagaaggucaccaucuccugcuccggcuccaacuccaacaucggcaacaacuacgucuccugguaccaccaccuccccggcaccgccccccgccuccucaucuacgacaacaacaagcgccccuccggcauccccgaccgcuucuccggcuccaaguccggcaccuccgccacccucgccaucaccggccuccagaccggcgacgaggccgacuacuacugcgccaccugggacggccgcgucuccgucaucggcaccggcacccaggucaccguccuc

SEQ ID NO: 17795 - RNA, 321 nt, Artificial Sequence
  derived and/or modified sequence opt2 from anti-HIV_119-016644_VR-Chain
caguccguccucacccagccccccuccgucuccgccgcccccggccagaaggucaccaucuccugcuccggcggcaccuccaacaucggcaacaacuacgucuccugguaccagcagcuccccggcaccgcccccaagcuccucaucuacgagaacaacaagcgccccuccggcauccccgcccgcuucuccgccgccaaguccggcaccuccgccacccucgccaucaccggccuccagaccgaggacgaggccgacuacuacugcgccaccugguccggcucccucaacaucggcaccggcaccaaggucaccguccuc

SEQ ID NO: 17796 - RNA, 333 nt, Artificial Sequence
  derived and/or modified sequence opt2 from anti-HIV_119-015878_VR-Chain
caguccgcccucacccagccccccuccgccuccggcucccccggccaguccgucaccaucuccugcuccggcuccuccuccaacaucggcaacaacuucgucuccugguaccagcagcgccccggcaccgcccccaagcuccucaucuacgagaccaacaagcgccccuccggcauccccgaccgcuucuccggcuccaaguccggcaccuccgccacccucgccaucaccggccuccagaccggcgacgaggccgacuacuacugcgccaccugggccccccgccucaacuccgcccgcgucuucggcaacggcaccauggucaccguccuc

SEQ ID NO: 17797 - RNA, 321 nt, Artificial Sequence
  derived and/or modified sequence opt2 from anti-HIV_119-015538_VR-Chain
caguccguccucacccagccccccuccgucuccgccacccccggccagaaggucaccaucuccugcuccggcuccuccuccaacaucggcaacaacuacgucuccugguaccgccgccuccccggcaccgcccccaagcaccucaucuacgagaccaacaaccgccccuccggcguccccgcccgccucuccgccgccaaguccggcaccuccgccacccucgccaucaccggccuccagaccgaggacgaggccgacuacuacugcgccaccugguccggcucccucaacaucggcaccggcaccaaggucaccguccuc

SEQ ID NO: 17798 - RNA, 321 nt, Artificial Sequence
  derived and/or modified sequence opt2 from anti-HIV_119-015455_VR-Chain
caguccguccucacccagccccccuccgucuccgccacccccggccagaaggucaccaucuccugcuccggcuccaacuccaacaucggcaacaaggacgucuccugguaccagcacuuccccggcaccgcccccaagcuccucaucuacgagaacaacaagcgccccuccggcauccccgaccgcuucuccggcuccaaguccgccaccuccgccacccucaccaucaccggccuccagaccgaggacgaggccgacuacuacugcgccaccugguccggcucccucaacaucggcaccggcaccaaggucaccguccuc

SEQ ID NO: 17799 - RNA, 321 nt, Artificial Sequence
  derived and/or modified sequence opt2 from anti-HIV_119-014425_VR-Chain
caguccguccucacccagccccccuccgucuccgccgcccccggccagaaggucaccaucuccugcuccggcggcaccuccaacaucggcaacaacuacgucuccugguaccagcaccuccccggcaccgcccccaagcuccucaucuacgagaacaacaagcgccccuccggcauccccgaccgcuucuccggcgccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17800 - RNA, 324 nt, Artificial Sequence
  derived and/or modified sequence opt2 from anti-HIV_119-013582_VR-Chain
caguccauggucacccagucccccuccgucuccgccgcccccggccagaaggucaccaucuccugcuccggcaccuccuccaacaucggccagaacuacgucuccugguaccagcagcuccccggcaccgcccccaagcuccucaucuccgagaacaaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17801 - RNA, 333 nt, Artificial Sequence
  derived and/or modified sequence opt2 from anti-HIV_119-013364_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaagcgccccuccggcauccccgaccgcuucuccggcuccaaguccggcaccuccgccacccucgccaucaccggccuccacaccggcgacgaggccgacuacuacugcaccgucuggggcguccgcaagggcgucggcgccgucuucggcaccggcaccaaggucaccguccuc

SEQ ID NO: 17802 - RNA, 333 nt, Artificial Sequence
  derived and/or modified sequence opt2 from anti-HIV_119-012886_VR-Chain
caguccauccucacccagccccccuccgucuccgccgcccccggccagaaggucaccaucuccugcuccggcuccuccuccaccaucggcaccaacuacgucuccugguaccagcaguuccccggcaccgcccccaagcuccucgucuucgagacccaccgccgccccuccggcauccccgaccgcuucuccggcuccaaguccggcaccuccgccacccucgccaucaccggccuccagaccggcgacgaggccgacuacuacugcgccgucuggggcguccgccgcggcgucggcgccgucuucggcgccggcaccaaggucaccguccuc

SEQ ID NO: 17803 - RNA, 333 nt, Artificial Sequence
  derived and/or modified sequence opt2 from anti-HIV_119-012249_VR-Chain
caguccguccucacccagccccccuccgucuccggcgcccccggccagaaggucaccaucuccugcuccggcuccuccuccaacaucggccgcaacuacgucuccugguaccagcagcuccccggcaccgcccccaagcuccucaucuacgagaacaacaagcgccccuccggcauccccgaccgcuucuccggcuccaaguccggcaccuccgccacccucgucaucaccggccuccagaccggcgacgaggccgacuucuacugcggcaccugggacggcucccucuccggcggcggcgucaucggcaccggcacccgcgucaccguccuc

SEQ ID NO: 17804 - RNA, 324 nt, Artificial Sequence
  derived and/or modified sequence opt2 from anti-HIV_119-012161_VR-Chain
caguccuuccucacccagccccccuccgucuccgccgcccccggccagaaggucaccaucuccugcuccggcuccaacuccaacaucggcaagaacuacgucuccugguaccaguaccuccccggcaccguccccaagcuccucaucuacgagaacgacaagcgccccuccggcauccccggccgcuucuccgccuccaaguccggcaccuccgccacccucgccaucaccggccuccagaccggcgacgaggccgacuacuacugcggcaccugggacggcuccggcggcgucuucggcaccggcaccaaggucaccguccuc

SEQ ID NO: 17805 - RNA, 324 nt, Artificial Sequence
  derived and/or modified sequence opt2 from anti-HIV_119-012110_VR-Chain
caguccguccucacccagccccccuccgucuccgccgcccccggccagaccgucaccaucuccugcuccggcuccaccuccaacaucggcaagaacgacgucuccugguaccagcagcuccccggcaccgcccccaagcuccucaucuccgagaacaaccgccgccccuccggcacccccgaccgcuucuccggcuccaaguccggcaccuccgccacccucgccaucuccggccuccagaccggcgacgaggccgacuacuacugcggcaccugggacggcuccggcggcgucuucggcaccggcaccaaggucaccguccuc

SEQ ID NO: 17806 - RNA, 333 nt, Artificial Sequence
  derived and/or modified sequence opt2 from anti-HIV_119-012100_VR-Chain
caggccguccucacccagccccccuccgucuccgccgcccccggccagaaggucgccaucuccugcuccggcuccuccuccaacaucggcaacaacuacgucuccugguaccagcagcuccccggcaccguccccaagcuccucaucuacgacaccgacaagcgccccuccggcauccccgaccgcuucuccggcuccaaguccggcaccuccgccacccucggcaucacccgccuccagaccggcgacgaggccgacuacuacugcgccaccugggccccccgccucaacuccgcccgcgucuucggcaacggcaccauggucaccguccuc

SEQ ID NO: 17807 - RNA, 324 nt, Artificial Sequence
  derived and/or modified sequence opt2 from anti-HIV_119-011651_VR-Chain
caguccguccucacccagccccccuccgucuccgccgcccccggccagaaggucaccaucuccugcuccggcaacuccuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcgccaccugggacggccgcgucuccgucuucggcaccggcaccaaggucgccguccuc

SEQ ID NO: 17808 - RNA, 333 nt, Artificial Sequence
  derived and/or modified sequence opt2 from anti-HIV_119-011479_VR-Chain
caguccguccucacccagccccccuccgucuccgccacccccggccagaaggucaccaucuccugcuccggcuccaacuccaacaucggcaacaaguacgucuccugguaccagcacuuccccggcaccgcccccaagcuccucaucuacgagaacaaccgccgccccuccggcauccccgaccgcuucuccggcuccaaguccggcaccuccgccacccucgccaucaccggccuccagaccggcgacgaggccgacuacuacugcaccaucuggggcguccgcaagggcgucggcgccgucuucggcaccggcaccaaggucaccguccuc

SEQ ID NO: 17809 - RNA, 333 nt, Artificial Sequence
  derived and/or modified sequence opt2 from anti-HIV_119-011232_VR-Chain
caguccguccucacccagccccccuccgucuccgccgcccccggccagaacgucaacaucuccugcuccggcggcuccuccaacaucggcuccaacuacgucuccugguaccagcaguuccccggcaccgcccccaagcuccucaucuacgacgacgacaagcgccccuccggcaucccccaccgcuucuccgccuccaaguccggcaccuccgccacccucgccaucuccggccuccagaccggcgacgaggccgacuacugcugcgccgucuggggcguccgccgcggcgccggcgccgucuucggcgccggcaccaaggucaccguccuc

SEQ ID NO: 17810 - RNA, 333 nt, Artificial Sequence
  derived and/or modified sequence opt2 from anti-HIV_119-011175_VR-Chain
caguccguccucacccagccccccuccgucuccgccgcccccggccagaaggucaccaucuccugcuccggcuccaacuccuacaucggcaacaaguacgucuccugguaccagcaguuccccggcaccgcccccaagcuccucaucuacgagaacaaccgccgccccuccggcauccccgaccgcuucuccggcuccaaguccggcaccuccgccacccucgccaucuccggccuccagaccggcgacgaggccgacuacugcugcgccgucuggggcguccgccgcggcgccggcgccgucuucggccccggcaccaaggucaccguccuc

SEQ ID NO: 17811 - RNA, 321 nt, Artificial Sequence
  derived and/or modified sequence opt2 from anti-HIV_119-008396_VR-Chain
caguccguccucacccagccccccuccgucuccgccgcccccggccagaaggucaccaucuccugcuccggcuccuccuccaacaucggcaacaacuacgucuccugguaccagcagguccccggcaccgcccccaagcuccucgucuacgagaacacccgccgccccuccggcguccccgaccgcuucuccggcgccaaguccggcaccuccgccacccucgccaucaccggccuccagaccggcgacgagggcgacuacuacugcgccaccugguccggcucccucaacaucggcaccggcaccaaggucaccguccuc

SEQ ID NO: 17812 - RNA, 324 nt, Artificial Sequence
  derived and/or modified sequence opt2 from anti-HIV_119-007148_VR-Chain
caguccguccucacccagccccccuccgucuccgccgcccccggccagaaggucaccaucuccugcuccggcuccaccuccaacaucggcaagaacuacgucuccugguaccagcaccuccccggcaccgcccccaagcuccuccucuacgagaacgaccgccgccccuccggcacccccgaccgcuucuccggcuccaaguccggcaccuccgccacccucgccaucaccggccuccacaccggcgacgaggccgacuacuacugcgagaccugggacggcuccggcggcgucuucggcaccggcaccaaggucaccguccuc

SEQ ID NO: 17813 - RNA, 333 nt, Artificial Sequence
  derived and/or modified sequence opt2 from anti-HIV_119-007029_VR-Chain
caguccguccucacccagccccccuccgucuccgccgcccccggccagaaggucaccaucuccugcuccggcaacuccuccaacaucggcaacaacuucgucuccugguaccagcagguccccggcaccgcccccaagcuccuccucuacgagaccuaccgccgccccuccggcaucuccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17814 - RNA, 324 nt, Artificial Sequence
  derived and/or modified sequence opt2 from anti-HIV_119-004707_VR-Chain
caguccguccucacccagccccccuccgucuccgccgcccccggccagaaggucaccaucuccugcuccggcuccaccuccaacaucggcaagaacgacgucuccugguaccagcagcuccccggcaccgcccccaagcuccucaucuccgagaacaaccgccgccccuccggcacccccgaccgcuucuccggcuccaaguccggcaccuccgccacccucgccaucaccggccuccagaccggcgacgaggccgacuacuacugcgagaccugggacggcuccggcggcgucuucggcaccggcaccaaggucaccguccuc

SEQ ID NO: 17815 - RNA, 333 nt, Artificial Sequence
  derived and/or modified sequence opt2 from anti-HIV_119-003910_VR-Chain
caguccguccucacccagccccccuccgucuccgccgcccccggccagaaggucgccaucuccugcuccggcaacaccuccuccaucggcaacaacuucgucuccugguaccagcagguccccggcaccgcccccaagcuccucgucuacgagaccuaccgccgccccuccggcauccccgaccgcuucuccggcuccaaguccggcaccuccgccacccucgccaucaccggccuccagaccggcgacgaggccgacuacuacugcaccgucuggggcguccgcaagggcgucggcgccgucuucggcaccggcaccaaggucaccguccuc

SEQ ID NO: 17816 - RNA, 321 nt, Artificial Sequence
  derived and/or modified sequence opt2 from anti-HIV_119-002450_VR-Chain
caguccguccucacccagccccccuccgucuccggcgcccccggccagcgcgucaccaucuccugcaccggcuccuccuccaacaucggcaacaacuacgucuccugguaccagggccuccccggcaccgcccccaagcuccucaucuacgagaacaacaagcgccccuccggcauccccgaccgcuucuccggcgccaaguccggcaccgccgccacccucgccaucaccggccuccagaccggcgacgaggccgacuacuacugcgccaccugguccggcucccucaacuucggcaccggcaccaaggucaccguccuc

SEQ ID NO: 17817 - RNA, 321 nt, Artificial Sequence
  derived and/or modified sequence opt2 from anti-HIV_119-001552_VR-Chain
caguccguccucacccagccccccuccgucuccgccgcccccggccagaaggucaccaucuccugcuccggcuccaacuccuaccucggcaacaaguacgucuccugguaccagcaguuccccggcaccgcccccaagcuccucaucuacgagaacaacaagcgccccuccggcauccccgaccgcuucuccgccuccaaguccgccgccuccgccacccucgccaucaccggccuccagaccggcgacgagggcgacuacuacugcgccaccuggaccggcucccucaacaucggcaccggcaccaaggucaccguccuc

SEQ ID NO: 17818 - RNA, 333 nt, Artificial Sequence
  derived and/or modified sequence opt2 from anti-HIV_059-188169_VR-Chain
caguccguccucacccagccccccuccgucuccgccgcccccggccagaaggucaccaucuccugcuccggcuccaccuccaacaucggcgacaacuacgucuccugguaccagcagguccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcggcaccugggacaccucccucuccaccggcggcgucuucggcaccggcaccaaggucaccguccuc

SEQ ID NO: 17819 - RNA, 333 nt, Artificial Sequence
  derived and/or modified sequence opt2 from anti-HIV_059-183739_VR-Chain
caguccguccucacccagccccccuccgucuccgccgcccccggccagaaggucaccaucuccugcuccggcuccaccuccaacaucggcaagaacuacgucuccugguaccagcagcuccccggcaccgcccccaagcuccucaucuacgagaacaaccgccgccccuccggcacccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17820 - RNA, 333 nt, Artificial Sequence
  derived and/or modified sequence opt2 from anti-HIV_059-182376_VR-Chain
caguccguccucucccagccccccuccgucuccgccgcccccggccagaaggucaccaucuccugcuccggcuccuccuccaacaucggcaacuacuacgucuccugguaccagcaguuccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccuggggcaccucccucuccggcggcggcgucuucggcaccggcaccaaggucaccguccuc

SEQ ID NO: 17821 - RNA, 333 nt, Artificial Sequence
  derived and/or modified sequence opt2 from anti-HIV_059-182199_VR-Chain
caguccguccucacccagccccccuccgucuccgccgcccccggccagaacaucaccaucuccugcuccggcuccuccuccaacaucggcucccacuccaucuccugguaccagcaccuccccggcaccgcccccaagaucgucaucuacgacaacgacaagcgcccccucggcauccccgaccgcuucuccggcuccaaguccggcaccuccgccacccucggcaucaccggccuccagaccggcgacgaggccgacuacuacugcggcaccugggacaccucccucuccggcggcggcgucuucggccccggcaccaaggucaccguccuc

SEQ ID NO: 17822 - RNA, 324 nt, Artificial Sequence
  derived and/or modified sequence opt2 from anti-HIV_059-169202_VR-Chain
cacuccguccucacccagccccccuccgucuccgccgcccccggccagaaggucaccaucuccugcuccggcuccuccuccaagaucggcaacaacuucgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcggcaccugggacggccgcgucuccgucaucggcuccggcaccaagcucaccguccuc

SEQ ID NO: 17823 - RNA, 324 nt, Artificial Sequence
  derived and/or modified sequence opt2 from anti-HIV_059-155645_VR-Chain
caguccgcccucacccagcccgccuccgucuccggcucccccggccaguccaucaccaucuccugcaccggcaccuccuccgacgucggcuacaacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcggcaccugggacggccgccucuccgucaucggcaccggcaccaaggucaccguccuc

SEQ ID NO: 17824 - RNA, 333 nt, Artificial Sequence
  derived and/or modified sequence opt2 from anti-HIV_059-151619_VR-Chain
caguccguccucacccagccccccuccgucuccgccgcccccggccagaaggucaccaucuccugcuccggcuccuccuccaacaucggcaacaacuucgucuccugguaccagcuccuccccggcaccccccccaagcuccucaucuucaagaacaacgagcgccccuccggcauccccgaccgcuucuccggcuccaaguccggcaccuccgccacccucggcaucaccggccuccagaccggcgacgagggcgacuacuacugcggcaccugggacaccucccucuccggcggcggcgucuucggcaccggcacccgcgucaccguccuc

SEQ ID NO: 17825 - RNA, 333 nt, Artificial Sequence
  derived and/or modified sequence opt2 from anti-HIV_059-146503_VR-Chain
caguccguccucacccagccccccuccgucuccgccacccccggccagaaggucaccaucuccugcuccggcuccgccuccaacaucggcaacaacuacgucuccugguaccagcaguuccccggcaccgcccccaagcuccucaucuacgacaccaacaagcgccccuccggcauccccgaccgcuucuccggcuccaaguccggcaccuccgccauccucggcaucaccggccuccagaucggcgacgaggccgacuacuacugcggcaccugggacaccucccucuccggcggcggcgucuucggcaccggcaccaaggucaccguccuc

SEQ ID NO: 17826 - RNA, 324 nt, Artificial Sequence
  derived and/or modified sequence opt2 from anti-HIV_059-136098_VR-Chain
caguccguccucacccagccccccuccgucuccgccgcccccggccagcgcgucaccaucuccugcuccggcuccuccuccaacaucggcaacaacuacgucuccugguaccagcagcuccccggcaccgcccccaagcuccucaucuacgagaacaaccgccgccccuccggcauccccgaccgcuucuccggcuccaaguccggcaccuccgccacccucgccaucaccggccuccagaccggcgacgagggcgacuacuacugcgcccgcugggacggccgccucuccgucaucggcuccggcaccaaggucaccguccuc

SEQ ID NO: 17827 - RNA, 333 nt, Artificial Sequence
  derived and/or modified sequence opt2 from anti-HIV_059-105516_VR-Chain
caguccgcccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgacaacaacaagcgccccuccggcauccccgaccgcuucuccggcuccaaguccggcaccuccgccacccucgccaucgccggccuccagaccggcgacgaggccaacuacuacugcggcaccugggacggcucccuccgcaccggcggcgucuucggcaccggcaccaaggucaccguccuc

SEQ ID NO: 17828 - RNA, 333 nt, Artificial Sequence
  derived and/or modified sequence opt2 from anti-HIV_059-095709_VR-Chain
caguccguccucacccagccccccuccgucuccgccgcccccggccagaaggucaccaucuccugcuccggccgcuccuccaacaucggcaacaacuucgucuccugguaccagcuccuccccggcaccgcccccaagcuccucaucuacaagaacaacgagcgccccuccggcauccccgaccgcuucuccgccuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 17829 - RNA, 333 nt, Artificial Sequence
  derived and/or modified sequence opt2 from anti-HIV_059-069468_VR-Chain
caguccguccucacccagccccccuccgucuccggcgccccccgccaguccgucaucaucuccugcaccggcuccuccuccaacaucggcggcuucgacguccacugguaccagcagcuccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17830 - RNA, 333 nt, Artificial Sequence
  derived and/or modified sequence opt2 from anti-HIV_059-060026_VR-Chain
caguccguccucacccagccccccuccgucuccgccgcccccggccagaaggucaccaucuccugcuccggcuccuccuccaacaucggcaacaacuacgucuccugguaccagcagcuccccggcaccguccccaagcuccucaucuacaagaacgacaagcgccccuccggcauccccgaccgcuucuccggcuccaaguccgccaccuccgccacccucggcaucaccggccuccagaccggcgacgaggccgacuacuacugcggcaucugggacaccucccucuccgccggcggcgucuucggcaccggcacccgcgucaccguccuc

SEQ ID NO: 17831 - RNA, 333 nt, Artificial Sequence
  derived and/or modified sequence opt2 from anti-HIV_059-053668_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgcuccuccggcauccccgaccgcuucuccggcuccaaguccggcaccuccgccacccucgccaucaccggccuccagaccggcgacgaggccgacuacuacugcggcacccgcgacuccucccucuccggcggcggcgucaucggcaccggcaccaaggucaccguccuc

SEQ ID NO: 17832 - RNA, 333 nt, Artificial Sequence
  derived and/or modified sequence opt2 from anti-HIV_059-052864_VR-Chain
caguccguccucacccagccccccucccucuccgccgcccccggccagcgcgucaccaucuccugcuccggcuccuccuccaacaucggcaacaacuacgucuccugguaccagcagcuccccggcaccgcccccaagcuccucaucuacgaguccaacaagcgccccuccggcacccccgaccgcuucuccggcuccaaguccggcaccuccgccacccucgccaucaccggccuccagaccggcgacgaggccgacuacuacugcggcaccugggacgccucccucuccuccggcggcgucaugggcaccggcaccaaggucaccguccuc

SEQ ID NO: 17833 - RNA, 333 nt, Artificial Sequence
  derived and/or modified sequence opt2 from anti-HIV_059-050968_VR-Chain
caguccguccucacccaggcccccuccgucuccgccgcccccggcgagaaggucaccaucuccugcuccggcaccuccuccaacaucggcuacuacuacgucuccugguaccagcaguuccccggcaccgcccccaaggucgucaucuacgagaacaaccgccgccccuccggcacccccgaccgcuucuccggcuccaaguccggcaccuccgccacccucgccaucaccggccuccagaccggcgacgaggccgacuacuacugcggcaccuggggcggcucccucuccaccggcggcgucaucggcaccggcaccaaggucaccguccuc

SEQ ID NO: 17834 - RNA, 333 nt, Artificial Sequence
  derived and/or modified sequence opt2 from anti-HIV_059-046422_VR-Chain
caguccguccucacccagccccccuccgucuccgccgcccccggccagaaggucaccaucuccugcuccggcuccuccuccaccaucggcaacaacuacaucuccugguaccagcuccuccccggcaccccccccaacuaccucaucuucaagaucuccgagcgccccuccggcguccccgaccgcuucuccggcuccaaguccggcaccuccgccacccuccacaucaccggccuccagaccggcgacgagggcgacuacuacugcggcaccugggacaccucccucuccggcggcggcgucuucggcaccggcaccaaggucaccguccuc

SEQ ID NO: 17835 - RNA, 333 nt, Artificial Sequence
  derived and/or modified sequence opt2 from anti-HIV_059-045120_VR-Chain
caguccguccucacccagccccccuccgucuccgccgcccccggccagaaggucgccaucuccugcuccggcuccuccuccaccaucggcaacaacuacgucuccugguaccagcuccuccccggcaccccccccaagcuccucaucuucaagucccacgagcgccccuccggcauccccgaccgcuucuccggcuccaaguccggcaccuccgccacccucggcaucaccggccuccagaccggcgacgagggcgacuacuacugcggcaccugggacuccucccucuccgucggcggcgucuucggcaccggcaccaaggucaccguccuc

SEQ ID NO: 17836 - RNA, 333 nt, Artificial Sequence
  derived and/or modified sequence opt2 from anti-HIV_059-039932_VR-Chain
caguccguccucacccagccccccuccgucuccgccgcccccggccagaaggucaccaucuccugcuccggcuccuccuccaucaucggcaagaacuacgucuccugguaccagcaccuccccggcaccgcccccaagcuccucaucuacgagaacaacaagcgccccuccggcauccccgaccgcuucuccggcuccaaguccggcaccuccgccacccucgccaucgccggccuccagaccggcgacgaggccaacuacuacugcggcaccuggggcggcucccucuccaccggcggcgucuucggcaccggcaccaaggucaccguccuc

SEQ ID NO: 17837 - RNA, 333 nt, Artificial Sequence
  derived and/or modified sequence opt2 from anti-HIV_059-038595_VR-Chain
caguccguccucacccagccccccuccgucuccgccgcccccggccagaaggucaccaucuccugcuccggccgcuccuccaacaucggcaacaacuucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaucguccuc

SEQ ID NO: 17838 - RNA, 333 nt, Artificial Sequence
  derived and/or modified sequence opt2 from anti-HIV_059-035082_VR-Chain
caguccguccucacccagccccccuccgucuccgccgcccccggccagaaggucaccaucuccugcuccggcuccaccuccaacaucggcaaguccuucgucuccugguaccagcagcuccccggcaccgcccccaagcuccucaucuacgacaacaaccgccgccccuccggcacccccgaccgcuucuccggcuccaaguccggcaccuccgccacccucgccaucaccggccuccagaccggcgacgaggccgacuacuacugcggcaccuggggcggcucccucuccaccggcggcgucaucggcaccggcaccaaggucaccguccuc

SEQ ID NO: 17839 - RNA, 333 nt, Artificial Sequence
  derived and/or modified sequence opt2 from anti-HIV_059-029204_VR-Chain
caguccguccucacccagccccccuccgucuccgccgcccccggccagaaggucaccaucuccugcuccggcuccaccuccaacaucggcaagauccucgucuccugguaccagcagcuccccggcaccgcccccaagcccuccaucuacgacaacaaccgccgccccuccggcacccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccgucccc

SEQ ID NO: 17840 - RNA, 324 nt, Artificial Sequence
  derived and/or modified sequence opt2 from anti-HIV_059-025235_VR-Chain
caguccguccucacccagccccccuccgucuccggcgcccccggccagaagaucaccaucuccugcuccggcuccaccuccaacaucggcaaguccuacgucuccugguaccagcagcuccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcggcaccugggacggcuccggcggcgucaucggcaccggcaccaaggucaccguccuc

SEQ ID NO: 17841 - RNA, 333 nt, Artificial Sequence
  derived and/or modified sequence opt2 from anti-HIV_059-015192_VR-Chain
caguccguccucacccagccccccuccgucuccgccgcccccggccagaaggucaccaucuccugcuccggcuccuccuccaccaucggcgacaaguacgucuccugguaccagcuccuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgucggcggcgucuucggcaccggcaccaaggucaccguccuc

SEQ ID NO: 17842 - RNA, 333 nt, Artificial Sequence
  derived and/or modified sequence opt2 from anti-HIV_059-007060_VR-Chain
caguccguccucacccagccccccuccgucuccgccgcccccggccagaaggucaccaucuccugcuccggcuccuccuccaacaucggcaacaaguacgucuccugguaccagcagcuccccggcaccgcccccaagcuccucaucuacgagaacaagaagcgccccuccggcauccccgaccgcuucuccggcuccaaguccggcaccuccgccacccucggcaucaccggccuccagaccggcgacgaggccgacuacuucugcggcaccugggacaccucccucuccggcggcggcgucuucggcuccggcaccaaggucaccguccuc

SEQ ID NO: 17843 - RNA, 324 nt, Artificial Sequence
  derived and/or modified sequence opt2 from anti-HIV_059-006953_VR-Chain
caguccguccucacccagccccccuccgucuccgccgcccccggccagaaggucaccaucuccugcuccggcuccuccuccaacaucggcgucuccugguaccagcagguccccggcaccgcccccaagcuccucaucuacgacaacgacaagcgccccaccggcauccccgaccgcuucuccggcuccaaguccggcaccuccgccauccucgccaucaccggccuccagaccggcgacgagggcgacuacuacugcggcaccugggagaccucccucuccggcggcggcgucuucggcaccggcaccaaggucaccguccuc

SEQ ID NO: 17844 - RNA, 333 nt, Artificial Sequence
  derived and/or modified sequence opt2 from anti-HIV_059-005953_VR-Chain
cacuccguccucacccagccccccuccgucuccgccgcccccggccagaaggucaccaucuccugcuccggcaccuccuccaacaucggcaagaacuacgucuccugguaccagcagcuccccggcaccgcccccaagcuccucaucuacgagaacaaccgccgccccuccggcacccccgaccgcuucuccggcuccaaguccggcaccuccgccacccucgccaucaccggccuccagaccggcgacgaggccgacuacuacugcggcaccugggacaccucccucuccaccggcggcgucuucggcaccggcaccaaggucaccguccuc

SEQ ID NO: 17845 - RNA, 324 nt, Artificial Sequence
  derived and/or modified sequence opt2 from anti-HIV_059-003725_VR-Chain
caguccguccucacccagccccccuccgucuccgccgcccccggccagaagcucaccaucuccugcuccggcuccaccuccaagaucggcaacaacuacgucuccugguaccagcaccuccccggcaccgcccccaagcuccucgucuacgagaacaacaagcgccccuccggcauccccgaccgcuucuccggcuccaaguccggcaccuccgccacccucgccaucaccggccuccagaccggcgacgaggccgacuacuacugcggcaccugggacggccgccucuccgucaucggcaccggcaccaaggucaccguccuc

SEQ ID NO: 17846 - RNA, 333 nt, Artificial Sequence
  derived and/or modified sequence opt2 from anti-HIV_059-002618_VR-Chain
cagcucguccucacccagccccccuccgucuccgccgcccccggccagaaggucaccaucuccugcuccggcuccuccuccaacaucggcaacaacuucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacacccgccucuccgccggcggcgucuucggcaccggcaccaaggucaccguccuc

SEQ ID NO: 17847 - RNA, 324 nt, Artificial Sequence
  derived and/or modified sequence opt2 from anti-HIV_059-001522_VR-Chain
caguccguccucacccagccccccuccgucuccgccgcccccggccagaaggucaccaucuccugcuccggcuccaacuccaacaucggcaacaacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcggcaccugggacggccgccucuccgucaucggcgccggcaccaaggucaucgucguc

SEQ ID NO: 17848 - RNA, 333 nt, Artificial Sequence
  derived and/or modified sequence opt2 from anti-HIV_059-000731_VR-Chain
caguccguccucacccagccccccuccgucuccgccgcccccggccagaaggucaccaucuccugcuccggcuccaccuccaacaucggcaacaaguacgucuccugguaccagcagguccccggcaccgcccccaagcuccucaucuacgagaacaaccgccgccccuccggcauccccgaccgcuucuccggcuccaaguccggcaccuccgccacccucgccaucaccggccuccagaccggcgacgaggccgacuacuacugcggcaccugggacgccucccuccgcaccggcggcgucaucggcaccggcaccaaggucaccguccuc

SEQ ID NO: 17849 - RNA, 333 nt, Artificial Sequence
  derived and/or modified sequence opt2 from anti-HIV_059-000634_VR-Chain
caguccguccucacccagccccccuccgucuccgccgcccccggccagaaggucaccaucuccugcuccggcuccuccuccaccaucggcaacaacuacgucuccugguaccaggucguccccggcaccgcccccaagcuccucaucuacaagaucaacgagcgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggccccggcaccaaggucaccguccuc

SEQ ID NO: 17850 - RNA, 333 nt, Artificial Sequence
  derived and/or modified sequence opt2 from anti-HIV_048-250757_VR-Chain
caguccguccucacccagccccccuccgucuccggcgcccccggccagcgcgucaccaucuccugcaccggcaccaccuccaacaucggcuccaacuacgucgccugguaccagcagcuccccggcaccgcccccaagcuccucaucuacgacaacgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17851 - RNA, 333 nt, Artificial Sequence
  derived and/or modified sequence opt2 from anti-HIV_048-250716_VR-Chain
caguccguccucacccagccccccuccgucuccgccgcccccggccagaaggucaccaucuccugcuccggcuccuccuccaacaucggcaacaaguacgucuccugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcggccaggccgacuacuacugcggcaccugggacaccucccucuccgccggcggcgucuucggcuccggcaccaaggucaccguccuc

SEQ ID NO: 17852 - RNA, 333 nt, Artificial Sequence
  derived and/or modified sequence opt2 from anti-HIV_048-250463_VR-Chain
caguccguccucacccagccccccuccgucuccgccgcccccggccagaaggucaccaucuccugcuccggcucccgcuccaacaacggcaacaacuacgucuccugguaccagcagcuccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcggcaccugggacuccucccucuccggcggcggcgucaucggcaccggcaccaagcucaccguccuc

SEQ ID NO: 17853 - RNA, 333 nt, Artificial Sequence
  derived and/or modified sequence opt2 from anti-HIV_048-248153_VR-Chain
caguccgcccucacccagcccgccuccgucuccgccuccuucggccaguccaucaccaucuccugcaccggcgccgccuccgacgucggcuacaacuacgucuccugguaccagcagcuccccggcaccacccccaagcuccucaucuaccgcaacaaccagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17854 - RNA, 333 nt, Artificial Sequence
  derived and/or modified sequence opt2 from anti-HIV_048-247532_VR-Chain
caguccguccucacccagccccccuccgucuccgccgcccccggccagcaggucaccaucuccugcuccggcaccaccuccaacaucggcaccaacuacgucuccugguaccagcagaugccccccgccgcccccaagcuccucaucuacgacaacaagaagcgccccuccgacauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17855 - RNA, 333 nt, Artificial Sequence
  derived and/or modified sequence opt2 from anti-HIV_048-245846_VR-Chain
caguccguccucacccagccccccuccgucuccgccacccccggccagcgcgucaccaucuccugcaccggcuccuccuccaacaucggcggcuacgacgucuccugguaccagguccuccccggcaccgcccccaagcuccucaucuacgacuccgacaagcgccccuccggcauccccgaccgcuucuccggcucccaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 17856 - RNA, 333 nt, Artificial Sequence
  derived and/or modified sequence opt2 from anti-HIV_048-244016_VR-Chain
caguccguccucacccagccccccuccgucuccggcgcccccggccagcgcgucaccaucuccugcaccggcuccuccuccaacaucggcggcuacgacguccacugguaccagcagcuccccggcaccgcccccaagcuccucaucuacaagaacgacaagcgccccuccggcauccccgaccgcuucuccggcuccaaguccggcaccuccgccauccucggcaucaccggccuccagaccggcgacgaggccgacuacuacugcggcgccugggacaccucccucuccgccggcggcgucuucggcaccggcaccaaggucaccguccuc

SEQ ID NO: 17857 - RNA, 333 nt, Artificial Sequence
  derived and/or modified sequence opt2 from anti-HIV_048-243682_VR-Chain
cagucccuccucacccagccccccuccgucuccgccgcccccggccagaaggucaccaucuccugcaccggcuccuccuccaacaucggcggcuacgacguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17858 - RNA, 333 nt, Artificial Sequence
  derived and/or modified sequence opt2 from anti-HIV_048-243588_VR-Chain
cagucccuccucacccagccccccuccgucuccgccccccccggccagauggucuccaucuccugcuccggcuccucccacaacaucggcgacaacuacgucuccugguaccagcaccuccccggcaccgcccccaagcuccucaucuacgacaacaacucccgccccuccggcauccccgaccgcuucuccggcuccaaguccggcaccuccgccacccucggcaucaccggccuccagaccggcgacgaggccgacuacuacugcggcaccugggacaccucccucuccggcggcggcgucuucggcaccggcaccaaggucaccguccuc

SEQ ID NO: 17859 - RNA, 333 nt, Artificial Sequence
  derived and/or modified sequence opt2 from anti-HIV_048-241775_VR-Chain
caguccguccucgcccagccccccuccgucuccggcgcccccggccagcgcgucaccaucuccugcaccggcuccuccuccaacaucggcgaguacgacguccacugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17860 - RNA, 333 nt, Artificial Sequence
  derived and/or modified sequence opt2 from anti-HIV_048-237996_VR-Chain
caguccguccucacccagccccccuccgucuccggcgcccccggccagcgcgucaccaucuccugcaccggcuccuccuccaacaucggcggcuacgacguccacugguaccgccagcuccccggcaccgcccccaagcuccucaucuacgacaccgucaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17861 - RNA, 330 nt, Artificial Sequence
  derived and/or modified sequence opt2 from anti-HIV_048-237730_VR-Chain
uccguccucacccagccccccuccgucuccggcgcccccggccagcgcgucaccaucuccugcaccggcaccaacuccaacuucggcuccaacuacgcccacugguaccagcagguccccggcaccgcccccaagcuccucaucuacuccaacaacgcccgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17862 - RNA, 333 nt, Artificial Sequence
  derived and/or modified sequence opt2 from anti-HIV_048-237253_VR-Chain
caguccguccucacccagccccccuccgucuccgccgcccccggccagaaggucaccgucuccugcuccggcuccuccuccaacaucggcuccaacgacgucuccugguaccagcaguuccccggcgccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17863 - RNA, 333 nt, Artificial Sequence
  derived and/or modified sequence opt2 from anti-HIV_048-234100_VR-Chain
caguccaugcucacccagccccccuccgucuccgccgcccccggcgagaaggucaccaucuccugcuccggcuccuccuccaacaucggcaagaccuucgucuccugguaccagcagguccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17864 - RNA, 333 nt, Artificial Sequence
  derived and/or modified sequence opt2 from anti-HIV_048-230882_VR-Chain
caguccguccucacccagccccccuccgucuccgccgcccccggccagaaggucaccaucuccugcuccggcaacuccuccaacaucggcuccaacuucgucuccugguaccagcagcuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucucccccggcggcgucuucggcaccggcaccaaggucaccguccuc

SEQ ID NO: 17865 - RNA, 333 nt, Artificial Sequence
  derived and/or modified sequence opt2 from anti-HIV_048-229473_VR-Chain
caguccguccucacccagccccccuccgucuccgccgcccccggccagaaggucaccaucuccugcuccggcuccuccuccaacaucggcaacaacuacgucuccugguaccagcaguuccccggcaccgcccccaagcuccucaucuacgagaacaacaagcgccccuccggcauccccgaccgcuucuccggcuccaaguccggcaccaccgccacccucgccaucacccgccuccagaccggcgacgaggccgacuacuacugcggcaccuggggcggcucccucuccgccggcggcgucuucggcaccggcaccaaggucaccguccuc

SEQ ID NO: 17866 - RNA, 333 nt, Artificial Sequence
  derived and/or modified sequence opt2 from anti-HIV_048-228238_VR-Chain
caguccguccucacccagccccccuccgucuccgccgcccccggccagaaggucaccaucuccugcuccggcuccuccuccaacaucggcaucaacuacgucuccugguaccagcagcuccccggcaccgcccccaagcuccucaucuacgacaacaccaagcgcccccagggcauccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17867 - RNA, 333 nt, Artificial Sequence
  derived and/or modified sequence opt2 from anti-HIV_048-228027_VR-Chain
cagucccuccucacccagucccccuccgccuccggcccccccggccagcgcgucaccaucuccugcuccggcuccaacuccaacaucggcuccaacaccgucaacugguaccaccaccuccccggcgccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17868 - RNA, 333 nt, Artificial Sequence
  derived and/or modified sequence opt2 from anti-HIV_048-227795_VR-Chain
caguccguccucacccagccccccuccgucuccgccgcccccggccagaaggucaccaucuccugcuccggcuccuccuccaacaucgagucccgcuccguccacugguaccagcagaagcccggccaggcccccguccucgucaucuacuacgacuccgaccgccccuccggcauccccgaccgcuucuccggcuccaaguccggcaccgccgccacccucggcaucaccggccuccagaccggcgacgaggccgacuacuacugcggcaccugggacaccucccucuccgccggcggcgucuucggcaccggcaccaaggucaccguccuc

SEQ ID NO: 17869 - RNA, 333 nt, Artificial Sequence
  derived and/or modified sequence opt2 from anti-HIV_048-227770_VR-Chain
caguccguccucacccagccccccuccgucuccggcgcccccggccagcgcgucaccaucuccugcaccggcuccuccuccaacaucggcccccgcgacguccacugguaccagcagcuccccggcaccguccccaagcuccucaucuacgacaccuacacccgccccuccggcauccccgaccgcuucuccggcuccaaguccggcgccuccgccacccucgacaucaccggccuccagaccggcgacgaggccgacuacuacugcggcaucugggacaccucccucuccgccggcggcgucuucggcaccggcaccaaggucaccguccuc

SEQ ID NO: 17870 - RNA, 333 nt, Artificial Sequence
  derived and/or modified sequence opt2 from anti-HIV_048-225298_VR-Chain
caguccgcccucacccagccccgcuccgucuccggcucccccggccaguccgucaccaucuccugcaccggcaccuccaacgacgucggcuacgacuacgucuccugguaccagcagcuccccggcaccgcccccaagcuccucaucuacgacaucaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17871 - RNA, 327 nt, Artificial Sequence
  derived and/or modified sequence opt2 from anti-HIV_048-225090_VR-Chain
gagcucacccagccccccuccgucuccggcgcccccggccagcgcgucaccaucuccugcaccggcuccuccuccaacaucggcggcuacgacguccacugguaccagcagcuccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17872 - RNA, 333 nt, Artificial Sequence
  derived and/or modified sequence opt2 from anti-HIV_048-224187_VR-Chain
caguccguccucacccagccccccuccgccuccggcacccccggccagcgcgucaccaucuccugcuccggcuccuccgccaacaucggcaccaacuacgucuucugguaccagcaccuccccggcaccaccccccgccuccucaucuuccgcaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17873 - RNA, 333 nt, Artificial Sequence
  derived and/or modified sequence opt2 from anti-HIV_048-223055_VR-Chain
caguccguccucacccagccccccuccgucuccgccgcccccggccagaaggucaccaucuccugcuccggcuccuccuccaacaucggcaacaacuacgucuccugguaccagcaguuccccggcaccgcccccaagguccucaucuacggcaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17874 - RNA, 333 nt, Artificial Sequence
  derived and/or modified sequence opt2 from anti-HIV_048-222711_VR-Chain
cagcccguccucacccagccccccuccgucuccggcgcccccggccagcgcgucaccaucuccugcaccggcuccuccuccaacaucggcggcuacgacguccacugguaccagcagguccccggcaccgcccccaagcuccucaucuucgagaacaaccgccgccccuccggcauccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17875 - RNA, 333 nt, Artificial Sequence
  derived and/or modified sequence opt2 from anti-HIV_048-221209_VR-Chain
caguccguccucacccagccccccuccgucuccggcgcccccggccagcgcgucaccaucuccugcaccggcaacuccuccaacaucggcgacuacgacguccacugguaccagcaggucgccggcaccgcccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17876 - RNA, 333 nt, Artificial Sequence
  derived and/or modified sequence opt2 from anti-HIV_048-220629_VR-Chain
caguccgcccucacccagcccgccuccgucuccggcucccucggccaguccaucaccaucuccugcaccggcaccucccgcgacgucggcuacuccuacgucuccugguaccagcaccuccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17877 - RNA, 333 nt, Artificial Sequence
  derived and/or modified sequence opt2 from anti-HIV_048-219430_VR-Chain
caguccguccucacccagccccccuccgucuccgccgcccccggccagauggucaccaucuccugcuccggcuccaccuccaacaucggcaucaacuacgucuccugguaccagcacguccccggcaccgcccccaagcuccucaucuacgacaacaacaagcgccccuccggcauccccgaccgcuucuccggcuccaaguccggcaccuccgccacccucggcaucaccggccuccacaccggcgacgaggccgacuacuacugcggcaccugggacaccucccucuccgccggcggcgucuucggcaccggcaccaaggucaccguccuc

SEQ ID NO: 17878 - RNA, 333 nt, Artificial Sequence
  derived and/or modified sequence opt2 from anti-HIV_048-216250_VR-Chain
caguccguccucacccagccccccuccgucuccgccgcccccggccagaaggucaccaucuccugcaccggcaccaccuccgacuucggcuacaacugcgucuccugguaccagcagcaccccggccgcgcccccaaggucaucaucuccggcgucaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17879 - RNA, 321 nt, Artificial Sequence
  derived and/or modified sequence opt2 from anti-HIV_048-216133_VR-Chain
acccagccccccucccucuccgccacccccggccagcgcgucuccaucuccugcuccggcggcggcuccaacaucggcaacaacgacgucuucugguuccagcaguuccccggcgccggcccccgccuccucaucuacgacaaccacaagcgccacuacggcacccccgaccgcuucuccggcuccaaguccggcaccuccgccacccucgccaucaccggccuccagaccggcgacgaggccgccuacuacugcggcaccugggacggcucccucuccaccggcggcgucaucggcaccggcaccaaggucaccguccuc

SEQ ID NO: 17880 - RNA, 333 nt, Artificial Sequence
  derived and/or modified sequence opt2 from anti-HIV_048-214886_VR-Chain
caguccgcccucacccagccccgcuccgucuccggcucccccggccaguccgucaccaucuccugcaccggcaccuccuccgacgucggcuacaacuacgucuccugguaccagcaccaccccggcaccgcccccaagcuccucaucuacaagaacaacaaccgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17881 - RNA, 333 nt, Artificial Sequence
  derived and/or modified sequence opt2 from anti-HIV_048-214709_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacgaccgccgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17882 - RNA, 333 nt, Artificial Sequence
  derived and/or modified sequence opt2 from anti-HIV_048-214001_VR-Chain
caguccguccucacccagccccccuccgucuccggcgcccccggccagaccgucaccaucuccugcuccggcuccaacuccaacaucggcaaccacgacguccacugguaccagcacguccccggcaccgcccccaagcuccucaucuacgacaacaacaagcgccccuccggcauccccgaccgcuucuccggcuccaaguccggcaccuccgccacccucggcaucaccggccuccagaccggcgacgaggccgaguacuacugcgccaccugggacgccucccucuccggcggcggcgucuuccgcaccggcaccaaggucaccguccuc

SEQ ID NO: 17883 - RNA, 333 nt, Artificial Sequence
  derived and/or modified sequence opt2 from anti-HIV_048-213230_VR-Chain
caguccguccucacccagccccccuccauguccgccgcccccggccagaaggucaccaucuccugcuccggcuccuccaacaacaucggcaagaacgucgucuccugguaccagcagcuccccggcaccgcccccaagguccucaucuacgagaacaacaagcgccucuccggcauccccgaccgcuucuccggcuccaaguccggcaccuccgccacccucgucaucaccggccuccagaccggcgacgaggccgacuacuacugcggcaccugggacuccucccucuccgccggcggcgucuucggcaccggcaccaaggucaccguccuc

SEQ ID NO: 17884 - RNA, 333 nt, Artificial Sequence
  derived and/or modified sequence opt2 from anti-HIV_048-212574_VR-Chain
caguccguccucacccagccccccuccgucuccgccgcccccggccagcgcgucaccgucuccugcuccggcuccaccuccaacaucgaguccaacuacgucuccugguaccagcagguccccggcaccgcccccaagcuccucaucuacgagaacaacaagcgccccuccggcauccccgaccgcuucuccggcuccaaguccggcaccuccgccacccucgccaucaccggccuccagaccggcgacgaggccgccuacuacugcggcaccugggacggcucccucuccaccggcggcgucaucggcaccggcaccaaggucaccguccuc

SEQ ID NO: 17885 - RNA, 333 nt, Artificial Sequence
  derived and/or modified sequence opt2 from anti-HIV_048-212207_VR-Chain
caguccguccucacccagccccccucccucuccgccgcccccggccagaaggucaccaucuccugcuccggcggcuccuccaacaucggcaacaacuacgucuccugguaccagcaccuccccggcaccgcccccaagcuccucaucuacgacaacuacaagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17886 - RNA, 333 nt, Artificial Sequence
  derived and/or modified sequence opt2 from anti-HIV_048-209146_VR-Chain
caguccguccucacccagccccccuccgucuccggcgcccccggccagaagaucaccgucuccugcaccggcaccaccuccaacaucggcccccacgacguccacugguaccagcucguccccggccgcccccccaagcuccucaucuuccacaacaacauccgccccuccggcauccccgaccgcuucuccggcuccaaguccggcauguccgccacccucggcaucaccggccuccagaccggcgacgaggccgacuacuacugcggcaccugggacuccucccucuccgccggcggcgucuucggcaccggcaccaaggucaccguccuc

SEQ ID NO: 17887 - RNA, 333 nt, Artificial Sequence
  derived and/or modified sequence opt2 from anti-HIV_048-208206_VR-Chain
caguccguccucacccagccccccuccgucuccgccgcccccggccagaaggucaccaucuccugcuccggcuccuccuccaacaucggcuccaacuacgucuccugguaccagcaguuccccggcaccgccccccgccuccucaucuacgagaacgacaagcgccccuccgccauccccgaccgcuucuccggcuccaaguccggcaccuccgccacccucggcaucaccggccuccacaccggcgacgaggccgacuacuacugcggcaccugggacggcucccucuccaccggcggcgucaucggcaccggcaccaaggucaccguccuc

SEQ ID NO: 17888 - RNA, 333 nt, Artificial Sequence
  derived and/or modified sequence opt2 from anti-HIV_048-208194_VR-Chain
caguccgcccucacccagccccccuccgccuccggcucccccggccaguccgucaccaucuccugcaccggcaccuccuccgacaucggcuacaaguacgucuccugguaccagcuccuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcgccugggacaccucccucuccgccggcggcgucuucggcaccggcaccaaggucaccguccuc

SEQ ID NO: 17889 - RNA, 333 nt, Artificial Sequence
  derived and/or modified sequence opt2 from anti-HIV_048-207744_VR-Chain
caguccgcccucacccagcccgccuccgucuccgccuccuucggccaguccaucaccaucuccugcaccggcgccgccuccaccaucggcaacaaccucgucuccugguaccgccuccuccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17890 - RNA, 333 nt, Artificial Sequence
  derived and/or modified sequence opt2 from anti-HIV_048-206501_VR-Chain
caguccguccucacccagccccccuccgucuccggcgcccccggccagcgcgucaccaucuccugcuccggcuccuccuccaacaucggcaacaacgccgucaacugguaccagcagcuccccggcaaggcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17891 - RNA, 333 nt, Artificial Sequence
  derived and/or modified sequence opt2 from anti-HIV_048-204221_VR-Chain
caguccguccucacccagccccccuccgccuccggcacccccggccagcgcgucaccaucuccugcuucggcuccuccuccaacaucgccuccuccgccgucaacugguaccagcagcuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17892 - RNA, 333 nt, Artificial Sequence
  derived and/or modified sequence opt2 from anti-HIV_048-204015_VR-Chain
caguccguccucacccagccccccuccgccuccggcacccccggccagcgcgucaccaucuccugcuccggcuccuccuccaacaucggcuccaaguacgucuacugguaccagcagcuccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17893 - RNA, 333 nt, Artificial Sequence
  derived and/or modified sequence opt2 from anti-HIV_048-201240_VR-Chain
caguccguccucacccagccccccuccgucuccgccgcccccggccagaaggucaccaucuccugcuccggcuccuccuccaacaucggcaacaacuacgucgccugguaccagcagcuccccggcaccgcccccaagcuccucaucaaggagaacucccagcgccccuccggcauccccgaccgcuucuccggcuccaaguccggcaccuccgccacccucgccaucaccggccuccagaccggcgacgaggccgacuacuacugcggcaccugggacaccucccucuccaccggcggcgucuucggcaccggcaccaaggucaccguccuc

SEQ ID NO: 17894 - RNA, 333 nt, Artificial Sequence
  derived and/or modified sequence opt2 from anti-HIV_048-200455_VR-Chain
caguccgcccucacccagcccgccuccgucuccggcucccccggccaguccaucaccaucuccugcaccggcaccuccuccgacgucggcuacaacuacgucuccugguaccagguccuccccggcaccgcccccaagcuccucaucuacaagaacaccgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17895 - RNA, 333 nt, Artificial Sequence
  derived and/or modified sequence opt2 from anti-HIV_048-200319_VR-Chain
caguccgucgucacccagccccccuccgccuccggcacccccggccagcgcgucaccaucuccugcuccggcuccuccuccaacaucggcuccaaguacgucuacugguaccaccagcaccccggcaccgcccccaagcuccucaucuacgacaacaacaaccgccccuccggcauccccgaccgcuucuccggcuccaaguccggcaccuccgccacccucggcaucaccggccuccagaccggcgacgaggccgacuacuacugcggcaccugggacaccucccucucccgcggcggcgucuucggcaccggcaccaaggucaccguccuc

SEQ ID NO: 17896 - RNA, 333 nt, Artificial Sequence
  derived and/or modified sequence opt2 from anti-HIV_048-197896_VR-Chain
caguccguccucacccagccccccuccgucuccgccgcccccggccagaaggucaccaucuccugcuccggcgccuccuacaacaucggcaagaacuccgucuccugguaccagcagcuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 17897 - RNA, 333 nt, Artificial Sequence
  derived and/or modified sequence opt2 from anti-HIV_048-193813_VR-Chain
caguccguccucacccagucccccuccgucuccgccgcccccggccagaaggucaccaucuccugcuccggcuccaacuccaacgucggcaacuacuacgucuccugguaccagcaccuccccggcaccgcccccaagguccucaucuacgagggcaacaagcgccccuccggcguccccgaccgcuucuccggcuccaaguccggcaccuccgccucccucgccaucaccggccuccagaccggcgacgaggccgacuacuacugcggcaccugggacaccucccucuccgccggcggcgucuucggcuccggcaccaaggucaccguccuc

SEQ ID NO: 17898 - RNA, 333 nt, Artificial Sequence
  derived and/or modified sequence opt2 from anti-HIV_048-192098_VR-Chain
caguccguccucacccagccccccuccgccuccggcacccccggccagcgcgucaccaucuccugcuccggcuccaccuccaacaucggcuccaacuacgucuacugguaccagcagcuccccggcaccacccccaagcuccucaucuacgagaacaacaagcgccccuccggcaucaccgaccgcuucuucggcuccaaguccggccccuccgccacccucgacaucaccggccuccagaccggcgacgaggccgacuacuacugcggcaccugggacgccucccucuccgccggcggcgucuucggcaccggcaccaaggucaccguccuc

SEQ ID NO: 17899 - RNA, 333 nt, Artificial Sequence
  derived and/or modified sequence opt2 from anti-HIV_048-191786_VR-Chain
caguccguccucacccagccccccuccgucuccgccgcccccggccagaacgucaacaucuccugcuccggcuccuccuccaacaucgagaacaacuucgucuccugguaccagaagcuccccggcaccgcccccaagcuccucaucuacgacaacaacaagcgccccuccggcauccgcgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17900 - RNA, 333 nt, Artificial Sequence
  derived and/or modified sequence opt2 from anti-HIV_048-188746_VR-Chain
caguccguccucacccagccccccuccgccuccggcacccccggccagaaggucaccaucuccugcuccggcuccaacuccaacaucggcuccaacuucgucuccugguaccagcuccuccccggcaccacccccaagcuccucaucuaccgcaacaaccagcgccccuccggcguccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17901 - RNA, 333 nt, Artificial Sequence
  derived and/or modified sequence opt2 from anti-HIV_048-185937_VR-Chain
caguccguccucacccagccccccuccgucuccgccgcccccggccagaaggucaccaucuccugcuccggcuccuccuccaacaucggcaacaacuacgucuccugguaccagcagcuccccggcaccgcccccaagcuccucaucuacgagaacaacaagcgccccuccggcauccccuaccccaucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17902 - RNA, 333 nt, Artificial Sequence
  derived and/or modified sequence opt2 from anti-HIV_048-184849_VR-Chain
caguccguccucacccaggcccccuccgccuccggcacccccggccagaccgucaccaucuccugcuccggcuccuccuccaacaucggcaccaaguacgucuacugguaccagcagcuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucucccccggcggcgucuucggcaccggcaccaaggucaccguccuc

SEQ ID NO: 17903 - RNA, 333 nt, Artificial Sequence
  derived and/or modified sequence opt2 from anti-HIV_048-183089_VR-Chain
caguccguccucacccagccccccuccgccuccggcacccccggccagcgcgucaccaucuccugcuccggcuccuccuccaacaucggcuccuccuacgucuacugguaccagcuccuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17904 - RNA, 333 nt, Artificial Sequence
  derived and/or modified sequence opt2 from anti-HIV_048-181509_VR-Chain
caguccguccucacccagccccccuccgucuccggcgcccccggccagcgcgucaccaucuccugcaccggcuccuccuccaacaucggcggcuacgacguccacugguaccaccagcuccccggcgccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17905 - RNA, 333 nt, Artificial Sequence
  derived and/or modified sequence opt2 from anti-HIV_048-180990_VR-Chain
caguccguccucacccagccccccuccgucuccgccgcccccggccagcgcgucaccaucuccugcuccggcuccaccuccaacaucggcaacaacuacgucuccugguaccagcacuuccccggcaagguccccaaggucgucaucuccgagaccaccaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17906 - RNA, 333 nt, Artificial Sequence
  derived and/or modified sequence opt2 from anti-HIV_048-177532_VR-Chain
caguccgcccucacccagccccccuccgccuccggcucccucggccaguccgucaccaucuccugcaccggcaccuccuccgacgucggcaacaacuucgucuccugguaccagaagaagcccggcaaggcccccaagcucaucgucuacgaggucaacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17907 - RNA, 324 nt, Artificial Sequence
  derived and/or modified sequence opt2 from anti-HIV_048-177426_VR-Chain
cucacccagccccacuccgucuccgagucccccggcaagaccgucaccaucuccugcaccggcaccuccuccgacgucggcuacaacuacgucuccugguaccagcaccaccccggcaaggcccccaagcuccucaucuacgaggucaccaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17908 - RNA, 333 nt, Artificial Sequence
  derived and/or modified sequence opt2 from anti-HIV_048-177389_VR-Chain
caguccguccucacccagccccccuccauguccgccgcccccggcgagcgcgucaccaucuccugcuccggcuccuccuccaacaucggcaaccaccacgucuccugguaccagcagcgccccggcaccgcccccaagcuccucaucuacgagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17909 - RNA, 333 nt, Artificial Sequence
  derived and/or modified sequence opt2 from anti-HIV_048-174266_VR-Chain
caguccguccucacccagccccccuccgucuccggcgcccccggccagcgcgucaccaucuccugcuccggcuccuccuccaacaucggcucccacuacgucuccugguaccagcagguccccggcaccgccccccgccucgucaucuacgacaccaucaagcgccacuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17910 - RNA, 333 nt, Artificial Sequence
  derived and/or modified sequence opt2 from anti-HIV_048-172847_VR-Chain
caguccguccucacccagccccccuccgucuccgccgcccccggccagcgcgucaccgucuccugcuccggcuccaccuccaacaucgaguccaacuacgucuccugguaccagcagguccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17911 - RNA, 333 nt, Artificial Sequence
  derived and/or modified sequence opt2 from anti-HIV_048-172845_VR-Chain
caguccgcccucacccagccccccuccgccuccggcucccccggccaguccgucaccaucuccugcaccggcaccuccuccgacgucggcuacaacuacgucuccugguaccagcagcuccccggcaccgcccccaagcuccucaucuaccgcaacaaccagcgccccuccggcguccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 17912 - RNA, 333 nt, Artificial Sequence
  derived and/or modified sequence opt2 from anti-HIV_048-172363_VR-Chain
caguccguccucacccagccccccuccgucuccgccgcccccggccagaaggucaccaucuccugcuccggcuccggcuccaacaucggcaacaccuacgucuccugguaccagcagcuccccggcaccgcccccaagcuccucaucuucgaggacaacaagcgccccuccggcauccccgaccgcuucuccggcuccaaguccggcaccuccgccacccucgccaucaccggccuccagaccggcgacgaggccgacuacuacugcggcaccugggacuccucccucuccggcggcggcgucaucggcaccggcaccaagcucaccguccuc

SEQ ID NO: 17913 - RNA, 333 nt, Artificial Sequence
  derived and/or modified sequence opt2 from anti-HIV_048-171609_VR-Chain
caguccguccucacccagccccccuccgucuccgccgcccccggccaggaggucaccaucuccugcuccgccuccuccuccuccaucggcaacgacuucgucuccugguaccagcagcuccccggcaccgcccccaagcuccucaucuacggcaacuccaaccgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17914 - RNA, 333 nt, Artificial Sequence
  derived and/or modified sequence opt2 from anti-HIV_048-170705_VR-Chain
caguccguccucacccagccccccuccgucuccgccgcccccggccagauggucaccaucuccugcuccggcuccaccuccaacaucggcaucaacuacgucuccugguaccagcacguccccggcaccgcccccaagcuccucaucuacgagaacgucgagcgccgcuccggcauccccgaccgcuucuccgccuccaaguccgccaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17915 - RNA, 333 nt, Artificial Sequence
  derived and/or modified sequence opt2 from anti-HIV_048-168381_VR-Chain
caguccgcccucacccagcccgccuccgucuccggcucccccggccaguccaucaccaucuccugcaccggcaccuccuccaacaucggcuccaacuacgucuccugguaccagcagcuccccggcaccgcccccaagcuccucaucuacgagaacaaccagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17916 - RNA, 333 nt, Artificial Sequence
  derived and/or modified sequence opt2 from anti-HIV_048-166619_VR-Chain
caguccguccucacccagccccccuccgucuccggcgcccccggccagcgcgucaccaucuccugcaccggcuccuccuccaacaucggcggcuaccacacccacugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17917 - RNA, 333 nt, Artificial Sequence
  derived and/or modified sequence opt2 from anti-HIV_048-162036_VR-Chain
caguccguccucgcccagccccccuccgucuccggcgcccccggccagaccgucaccaucuccugcaccggcuccuccuccaacaucggcggcuacgacguccacugguaccagcagcuccccggcaccgcccccaagcuccucaucuacaaggacgacaagcgccccuccggcauccccgaccgcuucuccggcuccaaguccggcaccuccgccacccucggcaucaccggccuccagaccggcgacgaggccgacuacuacugcggcaccugggacaccucccucaaccgcggcggcgucuucggcaccggcaccaaggucaccguccuc

SEQ ID NO: 17918 - RNA, 333 nt, Artificial Sequence
  derived and/or modified sequence opt2 from anti-HIV_048-160042_VR-Chain
caguccguccucacccagccccccuccgucuccgccgcccccggccagaaggucaccaucuccugcuccggcuccuccuccaacaucggcaucaacuacaucuccugguaccagcagcuccccggcaccgcccccaagauccucaucuacgacaacgacaagcgcccccucggcauccccgaccgcuucuccggcuccaaguccggcaccuccgccacccucggcaucaccggccuccagaccggcgacgaggccgacuacuacugcggcaccugggacgccucccucuccgccggcggcgucuucggcaccggcaccaaggucaccguccuc

SEQ ID NO: 17919 - RNA, 333 nt, Artificial Sequence
  derived and/or modified sequence opt2 from anti-HIV_048-159676_VR-Chain
caguccguccucacccagccccccuccgucuccgccucccccggccagaaggucaccaucuccugcuccggcuccuccuccgacaucggcuccaacuacgucuccugguacguccagcuccccggcaccgcccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17920 - RNA, 333 nt, Artificial Sequence
  derived and/or modified sequence opt2 from anti-HIV_048-159500_VR-Chain
caguccguccucacccagccccccuccgucuccgccgcccccggccagaacgucaccaucuccugcuccggcuccugguccaacaucggcgccaacuacgucuccugguaccagcagcuccccggcaccgcccccaagcuccucaucuacgagaacaacaagcgccccuccggcauccccgaccgcuucuccggcuccaaguccggcaccuccgccacccucggcuucaccggccuccagaccggcgacgaggccgacuacuacugcggcaccugggacaccucccucuccgccggcggcgucuucggcaccggcaccaaggucaccguccuc

SEQ ID NO: 17921 - RNA, 333 nt, Artificial Sequence
  derived and/or modified sequence opt2 from anti-HIV_048-159421_VR-Chain
cagucccuccucacccaggcccccuccgucuccgccgcccccggccagaccgucaccaucuccugcuccggcuccaacgccgacaucggcaagaacuucgucuccugguaccagcagucccccggcgccgcccccaagcuccucaucuacgagaacgaccgccgccccuccggcauccccgaccgcuucuccggcuccaaguccggcaccuccgccacccucggcaucaccggccuccagaccggcgacgaggccgaguacuacugcgccaccugggacgccucccucuccggcggcggcgucuucggcaccggcaccaaggucaccguccuc

SEQ ID NO: 17922 - RNA, 333 nt, Artificial Sequence
  derived and/or modified sequence opt2 from anti-HIV_048-159333_VR-Chain
caguccguccucacccagccccccuccgccuccggcacccccggccagcgcgucaccaucuccugcuccggcuccaacuccaacaucggcuccgacuccgucuacugguaccagcagcuccccggccgcucccccaagcuccucaucuaccgcaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17923 - RNA, 333 nt, Artificial Sequence
  derived and/or modified sequence opt2 from anti-HIV_048-158932_VR-Chain
caguccguccucacccagcccgccuccgucuccggcucccccggccaguccaucaccaucuccugcuccggcuccuccuccaacaucggcgacaucuucgucuccugguaccagcagguccccggcgccgcccccaagcuccucaucuacgacaacgacaagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17924 - RNA, 333 nt, Artificial Sequence
  derived and/or modified sequence opt2 from anti-HIV_048-155811_VR-Chain
caguccgcccucacccagcccgccuccgucuccggcucccccggccaguccaucaccaucuccugcaccggcaccuccuccgacgucggcuacgacuacgucuccugguaccagcuccuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 17925 - RNA, 333 nt, Artificial Sequence
  derived and/or modified sequence opt2 from anti-HIV_048-155464_VR-Chain
caguccgcccucacccagcccgccuccgucuccggcucccccggccaguccaucaccaucuccugcaccggcgccaccggcgacuccggccacaccuacgucuccugguaccagcagcuccccggcaccgcccccaagcuccucaucuacuccaacaacgagcgccccuccggcguccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17926 - RNA, 333 nt, Artificial Sequence
  derived and/or modified sequence opt2 from anti-HIV_048-155392_VR-Chain
caguccguccucacccagccccccuccgucuccgccgcccccggccagauggucaccaucuccugcuccggcuccuccuccaacaucggcgacaacuacgucuccugguaccagcagcuccccggccgcggccccaagcuccucgucuacgacaccuacaagcgcuaccucgagacccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17927 - RNA, 333 nt, Artificial Sequence
  derived and/or modified sequence opt2 from anti-HIV_048-155389_VR-Chain
caguccguccucacccagccccccuccgucuccgccgcccccggccagaaggucaccaucuccugcuccggcaucuccuccaacaucggcaacaaccccgucuccugguaccagcaguuccccggcaccgcccccaagcuccucaucuacaagaacgacaagcgccccuccggcauccccgaccgcuucuccggcuccaaguccggcaccuccgccacccucggcaucaccggccuccagaccggcgacgaggccgacuacuacugcggcaccugggacaccucccucuccaccggcggcgucuucggcaccggcaccaaggucaccguccuc

SEQ ID NO: 17928 - RNA, 333 nt, Artificial Sequence
  derived and/or modified sequence opt2 from anti-HIV_048-154449_VR-Chain
caguccguccucaagcagccccccuccgucuccggcgcccccggccuccgcgucaccaucuccugcaccggcggcuccuccaacaucggcggcuucgacguccacugguaccagcacuuccccggcaccgcccccaagcuccucaucuacgacaacgaccagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17929 - RNA, 333 nt, Artificial Sequence
  derived and/or modified sequence opt2 from anti-HIV_048-153379_VR-Chain
caguccguccucacccagccccccuccgucuccgccacccccggccagaaggucaccaucuccugcuccggcucccgcuccaacaucggcucccacuacgucuccugguaccagcaguuccccgaguccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17930 - RNA, 333 nt, Artificial Sequence
  derived and/or modified sequence opt2 from anti-HIV_048-153171_VR-Chain
caguccguccucacccagccccccuccgucuccgccgcccccggccagaaggucaccaucuccugcuccggcuccaccuccaacaucgaggacaucuacgucuccugguaccagcaccuccccggcaccgcccccaagcuccucaucuacgacaacaacaagcgccccuccggcauccccgaccgcuucuccggcuccaaguccggcaccuccgccacccucgccaucaccggccuccagaccggcgacgaggccgacuacuacugcggcaccugggacaccucccucuccgccggcggcgucuucggcaccggcaccaaggucaccguccuc

SEQ ID NO: 17931 - RNA, 333 nt, Artificial Sequence
  derived and/or modified sequence opt2 from anti-HIV_048-152324_VR-Chain
caguccauggucacccagucccccuccgucuccgccgcccccggccagaaggucaccaucuccugcuccggcaccuccuccaacaucggccagaacuacgucuccugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17932 - RNA, 333 nt, Artificial Sequence
  derived and/or modified sequence opt2 from anti-HIV_048-146102_VR-Chain
caguccguccucacccagccccccuccgucuccgccgcccccggccagaaggucaccaucuccugcuccggcuccuccuccaccaucggcaacaacuacaucuccugguaccagcuccuccccggcaccccccccaagcuccucaucuacaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17933 - RNA, 333 nt, Artificial Sequence
  derived and/or modified sequence opt2 from anti-HIV_048-145984_VR-Chain
caguccguccucacccagccccucuccgucuccggcgcccccggccagcgcgucaccaucuccugcaccggcuccuccuccaacaucggcuccaacuucgucuccugguaccagguccuccccggcaccacccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcgccugggacaccucccucuccgccggcggcgucuucggcaccggcaccaaggucaccguccuc

SEQ ID NO: 17934 - RNA, 333 nt, Artificial Sequence
  derived and/or modified sequence opt2 from anti-HIV_048-145371_VR-Chain
caguccguccucacccagccccccuccgucuccgccgccuccggccagaaggucuccauccccugcuccggcggcaccuccaacaucggcgacaacuacgucuccugguuccagcaguuccccggcuccgcccccaagauccucaucuacgacuccgacaagcgccccucccgcaucuccgaccgcuucuccgccuccaaguccggcaccuccgccacccucgacaucacccgccuccagaccggcgacgaggccgacuacuacugcggcaccugggacaccucccucuccgccggcggcgucuucggcaccggcaccaaggucaccguccuc

SEQ ID NO: 17935 - RNA, 333 nt, Artificial Sequence
  derived and/or modified sequence opt2 from anti-HIV_048-144907_VR-Chain
caguccgcccucacccagcccgccuccgucuccggcucccccggccaguccaucaccaucuccugcaccggcacccgccgcgacgucggcuucaacuacgucuccugguaccagcagcaccccggcaccgcccccaagcuccucaucuacgagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17936 - RNA, 333 nt, Artificial Sequence
  derived and/or modified sequence opt2 from anti-HIV_048-142298_VR-Chain
caguccguccucacccagccccccuccgccuccggcacccccggccagcgcgucaccaucuccugcuccggcuccuccuccaccaucggcaacaacuacaucuccugguaccagcuccuccccggcaccccccccaagcuccucaucuucaagaacaacgagcgccccuccggcauccccgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17937 - RNA, 333 nt, Artificial Sequence
  derived and/or modified sequence opt2 from anti-HIV_048-142277_VR-Chain
caguccguccucacccagccccccuccgucuccggcgcccccggccagcgcaucaccaucuccugcaccggcuccuccuccaacaucggcgccuacgacguccagugguaccagcaccuccccggcaccgcccccaagcuccucaucuacaagaacaccgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17938 - RNA, 333 nt, Artificial Sequence
  derived and/or modified sequence opt2 from anti-HIV_048-141934_VR-Chain
caguccguccucacccagccccccuccgucuccggcgcccccggccagcgcgucaccaucuccugcaccggcaacuccuccaacaucggcgccuacgacguccacugguaccagcagcuccccggcaccgcccccaagcucaugaucuacgaggucuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17939 - RNA, 333 nt, Artificial Sequence
  derived and/or modified sequence opt2 from anti-HIV_048-141207_VR-Chain
caguccguccucacccagccccccuccgucuccgccgcccccggccagaaggucaccaucgccugcuccggcuccuccuccaacaucggcaacaacuacgucuccugguaccagcagcuccccggcaccgcccccaagcuccucaucuacgccaacaaccgccgccccuccggcauccccgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17940 - RNA, 333 nt, Artificial Sequence
  derived and/or modified sequence opt2 from anti-HIV_048-140796_VR-Chain
caguccguccucacccagccccccuccgucuccgccacccccggccagaaggucaccaucuccugcuccggcacccgcuccaacaucggcaacaacuacgucuccugguaccgccaguuccccggcaccgcccccaagcuccucaucuacgaggacaacaagcgccccuccggcauccccgcccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17941 - RNA, 333 nt, Artificial Sequence
  derived and/or modified sequence opt2 from anti-HIV_048-139893_VR-Chain
caguccguccucacccagccccccuccgucuccgccacccccggccagaaggucaccuucuccugcuccggcuccuccuccaccaucggcaagaacuacgucuccugguaccagguccuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcggcaccugggacuccucccucuccgccggcggcgucuucggcaccggcaccaaggucaccguccuc

SEQ ID NO: 17942 - RNA, 333 nt, Artificial Sequence
  derived and/or modified sequence opt2 from anti-HIV_048-138820_VR-Chain
caguccguccucacccagccccccuccgucuccggcgcccccggccagaaggucaccaucuccugcuccggcuccggcuccaacaucggcaacaccuacgucuccugguaccagcaccuccccggcaccgcccccaagcuccucaucuacgagaacaacaagcgccccuccggcauccccgaccgcuucuccggcuccaaguccgccaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17943 - RNA, 333 nt, Artificial Sequence
  derived and/or modified sequence opt2 from anti-HIV_048-135858_VR-Chain
caguccguccucacccagccccccuccgccuccggcacccccggccagcgcgucaccaucuccugcuccggcuccuccuccaacaucggcuccuccuacgucuacugguaccagcaguuccccggccgcuccccccgccuccucaucuaccgcaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17944 - RNA, 333 nt, Artificial Sequence
  derived and/or modified sequence opt2 from anti-HIV_048-134968_VR-Chain
caguccguccucacccagccccccuccgucuccgccgcccccggccagaaggucaccaucuucugcuccggcuccuccuccaacaucggcaagaacuacgucuccugguaccagcagcuccccggcaccgcccccaagcuccucaucuacgagaacuccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17945 - RNA, 333 nt, Artificial Sequence
  derived and/or modified sequence opt2 from anti-HIV_048-134312_VR-Chain
caguccguccucacccagccccccuccgccuccggcacccccggccagcgcgucaccaucuccugcuccggcuccuccuccaacaucggcaacaacuacgucuccugguaccgccuccuccccggcaccgcccccaagcuccucaucuacaagaacgacaaccgccccuccggcauccccgaccgcuucuccggcuccaaguccggcaccuccgccacccucggcaucuccggccuccagaccggcgacgaggccgacuacuacugcggcaccugggacaccucccucuccggcggcggcgucuucggcaccggcaccaaggucaccguccuc

SEQ ID NO: 17946 - RNA, 330 nt, Artificial Sequence
  derived and/or modified sequence opt2 from anti-HIV_048-132253_VR-Chain
uccgcccucacccagcccgccuccgucuccggcucccccggccaguccaucgccaucuccugcaccggcaccuccuccgacgucggcuacgaccucgucuccugguaccagcagcaccccggcaccgcccccaagcuccucaucuacgacaacaacaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17947 - RNA, 333 nt, Artificial Sequence
  derived and/or modified sequence opt2 from anti-HIV_048-130710_VR-Chain
caguccguccucacccagccccccuccgucgccggcgcccccggccagcgcgucaccaucuccugcaccggcaacaccuccaacaucggcggcuacgacguccacugguaccagcagcuccccggcaccccccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17948 - RNA, 333 nt, Artificial Sequence
  derived and/or modified sequence opt2 from anti-HIV_048-128564_VR-Chain
caguccguccucacccagccccccuccgccuccggcacccccggccagcgcgucaccaucuccugcuccggcuccuccuccaacaucggcuccaacaccgucaacugguaccagcagcuccccggcaccgcccccaagcuccucaucuacaagaacaccgagcgccccuccggcauccccgaccgcuucuccggcuccaaguccggcaccuccgccacccucgacaucaccggccuccagaccggcgacgaggccgacuacuacugcggcaccugggacaccucccucuccgccggcggcgucuucggcaccggcaccaaggucaccguccuc

SEQ ID NO: 17949 - RNA, 333 nt, Artificial Sequence
  derived and/or modified sequence opt2 from anti-HIV_048-126702_VR-Chain
caguccguccucacccagccccccuccgccuccgccgcccccggccagcgcgucaccaucuccugcuccggcuccaacuccaacaucggcaacaacuacgucuccugguaccagcagcuccccggcaccgcccccaagcuccucaucuacgacaacuccaagcgccccuccggcauccccgaccgcuucuccgccuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17950 - RNA, 333 nt, Artificial Sequence
  derived and/or modified sequence opt2 from anti-HIV_048-124521_VR-Chain
caguccguccucacccagccccccuccgucuccggcgcccccggccagcgcgucaccaucuccugcaccggcuccuccuccaccuucggcggcuacgacgucuacugguaccagcagauccccggcaccgcccccaagcuccucaucuacgagaacaacaagcgccccuccggcauccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17951 - RNA, 333 nt, Artificial Sequence
  derived and/or modified sequence opt2 from anti-HIV_048-122740_VR-Chain
caguccguccucacccagccccccuccauguccgccgcccccggccaguccgucaccaucuccugcuccggcuccaccuucaacaucgagaagcaccaggucaccuggcuccgccaccuccccggcaccgcccccaccuccgucaucaucaugaacucccagcgccccuccggcacccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17952 - RNA, 327 nt, Artificial Sequence
  derived and/or modified sequence opt2 from anti-HIV_048-119536_VR-Chain
gagcucacccagucccccuccgucuccgccgcccccggcgagaaggucaccaucuccugcuccggcaccaacuccaacaucggcuacuacuacgucuccugguaccagcaguuccccggcaccgcccccaaggucgucaucuacgagaacaccaagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcuccggcaccaaggucaccguccuc

SEQ ID NO: 17953 - RNA, 333 nt, Artificial Sequence
  derived and/or modified sequence opt2 from anti-HIV_048-116929_VR-Chain
caguccguccucacccagccccccuccgucuccggcgcccccggccagcgcgucaccaucuccugcaccggcuccuccuccaacaucggcgacuacgacguccacugguaccagcagcuccccggcaccgcccccaagcuccucaucuaccgcaacaaccagcgccccuccggcguccccgaccgcuucuccggcuccaaguccggcaccuccgccacccucggcaucaccggccuccagaccggcgacgaggccgacuacuacugcggcaccugggacgccucccucuccgccggcggcgucuucggcaccggcaccaaggucaccguccuc

SEQ ID NO: 17954 - RNA, 333 nt, Artificial Sequence
  derived and/or modified sequence opt2 from anti-HIV_048-116577_VR-Chain
caguccguccucacccagccccccuccgccuccggcacccccggccagcgcgucaccaucuccugcuccggcuccuccuccaacaucggcuccaacuacgucuccugguaccagguccuccccggcaccgcccccaagcuccucaucuacaagaacaacaagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc

SEQ ID NO: 17955 - RNA, 333 nt, Artificial Sequence
  derived and/or modified sequence opt2 from anti-HIV_048-116046_VR-Chain
caguccguccucacccagccccccuccgucuccggcgcccccggccagcgcgucaccaucuccugcaccggcuccuccuccaacaucggcggcuacgacguccacugguaccagcaguuccccggcaccgcccccaagcuccucaucuacgacaacgacaagcgccccuccggcauccccgaccgcuucuccggcuccaaguccggcaccuccgccacccucggcaucaccggccuccagaccggcgacgaggccaacuacuacugcggcgccugggacaccucccucuccgccggcggcgucuucggcaccggcaccaaggucaccguccuc

SEQ ID NO: 17956 - RNA, 333 nt, Artificial Sequence
  derived and/or modified sequence opt2 from anti-HIV_048-115875_VR-Chain
caguccguccucacccagccccccuccgucuccgccgcccccggccagcgcgucaccgucuccugcuccggcuccuccuccaacaucggcaacaacuucgucuccugguaccagcaccuccccggcaccgcccccaagcuccucaucuacgacaacuccaaccgccccuccggcauccccgaccgcuucuccggcuccaaguccggcaccuccgccacccucggcaucaccggccuccacaccggcgacgaggccgacuacuacugcggcaccugggacaccucccucuccgccggcggcgucuucggcuccggcaccaaggucaccguccuc

SEQ ID NO: 17957 - RNA, 333 nt, Artificial Sequence
  derived and/or modified sequence opt2 from anti-HIV_048-115599_VR-Chain
caguccguccucacccagccccccuccgucuccgccgcccccggccagauggucaccaucuccugcuccggcuccuccuccaacaucggcucccacuccgucuccugguaccagcacuuccccggcaccgcccccaagcucgucaucgaggagaacgaccagcgccccuccggcauccccgaccgcuucuccggcuccaaguccggcaccuccgccacccucggcaucaccggccuccagaccggcgacgagggcgacuacuacugcggcaccugggacaccucccucuccggcggcggcgucuucggcaccggcaccaaggucaccguccuc

SEQ ID NO: 17958 - RNA, 333 nt, Artificial Sequence
  derived and/or modified sequence opt2 from anti-HIV_048-113988_VR-Chain
caguccguccucacccagccccccuccgucuccgccgcccccggccagauggucaccaucuccugcuccggcuccucccacaacaucggcgagaacuacgucuccugguaccagcaccuccccggcaccgcccccaagcuccucaucuucaagaacaacgagcgccccuccggcauccccgaccgcuucuccggcuccaaguccggcaccuccgccacccucggcaucaccggccuccagaccggcgacgaggccgacuacuacugcggcaccugggacaccucccucuccgccggcggcgucuucggcaccggcaccaaggucaccguccuc

SEQ ID NO: 17959 - RNA, 333 nt, Artificial Sequence
  derived and/or modified sequence opt2 from anti-HIV_048-112989_VR-Chain
caguccguccucacccagccccccuccgccuccggcacccccggccagcgcgucacccucuccugcuccggcggcuccuccaacaucggcaacgacaacgucuacugguaccagcagcgccccggcaccacccccaagcuccucaucuacaacgacaaccgccgccccuccggcacccccgaccgcuucuccggcuccaaguccggcaccuccgccacccucgccaucaccggccuccagaccggcgacgaggccgacuacuacugcggcaccugggacggcucccucuccaccggcggcgucaucggcaccggcaccaaggucaccguccuc

SEQ ID NO: 17960 - RNA, 333 nt, Artificial Sequence
  derived and/or modified sequence opt2 from anti-HIV_048-112435_VR-Chain
caguccguccucacccagccccccuccgucuccgccgcccccggccagaaggucuccaucuccugcuccggcuccuccuccaacaucggcaagaacuacgucuccugguaccagcagcuccccggcaccgcccccaagcuccucaucuucaagaacaacgagcgccccuccggcauccccgaccgcuucuccggcuccaaguccggcaccuccgccacccucggcaucaccggccuccagaccggcgacgaggccgacuacuacugcgccaccugggacaccucccucuccgccggcggcgucuucggcaccggcaccaaggucaccguccuc
